United States Patent
Sandy et al.

(10) Patent No.: US 10,576,111 B2
(45) Date of Patent: *Mar. 3, 2020

(54) **METHOD OF TREATING CANCER USING *BIFIDOBACTERIUM ANIMALIS* SSP. *LACTIS* STRAIN PTA-125097**

(71) Applicant: Evelo Biosciences, Inc., Cambridge, MA (US)

(72) Inventors: Peter Sandy, Revere, MA (US); Jacqueline Papkoff, San Francisco, CA (US); Maria Sizova, Roslindale, MA (US); Brian Goodman, Jamaica Plain, MA (US); Humphrey Gardner, Marblehead, MA (US); Holly Ponichtera, Cambridge, MA (US)

(73) Assignee: Evelo Biosciences, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/376,253

(22) Filed: Apr. 5, 2019

(65) Prior Publication Data

US 2019/0224253 A1 Jul. 25, 2019

Related U.S. Application Data

(63) Continuation of application No. 16/027,684, filed on Jul. 5, 2018.

(60) Provisional application No. 62/528,669, filed on Jul. 5, 2017.

(51) Int. Cl.
*A61K 35/745* (2015.01)
*A61K 45/06* (2006.01)
*A61P 35/00* (2006.01)
*A61K 9/00* (2006.01)
*A61K 35/17* (2015.01)

(52) U.S. Cl.
CPC .......... *A61K 35/745* (2013.01); *A61K 9/0019* (2013.01); *A61K 9/0053* (2013.01); *A61K 35/17* (2013.01); *A61K 45/06* (2013.01); *A61P 35/00* (2018.01)

(58) Field of Classification Search
CPC .. A61K 35/741; A61K 35/745; A61K 35/742; A61K 35/747; A61K 39/39558; A61K 9/0053; A61K 2035/115; A61K 31/7004; A61K 31/7016; A61K 2300/00; A61K 31/715; A61K 35/39; A61K 35/74; A61K 35/744; A61K 38/46; A61K 45/06; A61K 9/0031; A61K 9/19; A61K 2039/505; A61K 31/702; A61K 31/716; A61K 31/733; A61K 31/047; A61K 31/19; A61K 31/192; A61K 31/197; A61K 31/198; A61K 35/17; A61K 9/0019; A61K 35/37; A61K 9/48; A61K 9/4816; A61K 38/13; A61K 2035/11; A61K 2039/52; A61K 39/0208; A61K 9/4891; A61K 2039/521; A61K 2039/541; A61K 2039/542; A61K 2039/545; A61K 2035/55594; A61K 2039/58; A61K 2039/70; A61K 31/43; A61K 31/7008; A61K 31/7048; A61K 38/00; A61K 38/164; A61K 39/0216; A61K 39/0275; A61K 39/07; A61K 39/39; Y02A 50/401; Y02A 50/414; Y02A 50/473; Y02A 50/47; Y02A 50/481; Y02A 50/402; Y02A 50/475; Y02A 50/478; Y02A 50/48; Y02A 50/469; Y02A 50/49; Y02A 90/26; Y02A 50/479; Y02A 50/482; C07K 16/2827; C07K 2317/76; C07K 14/54; C07K 16/24; A61P 35/00; A61P 1/00; A61P 35/04; A61P 3/02; A61P 43/00; A23L 33/125; A23L 33/135; A23L 33/127; A23L 33/40; A23L 2/52; A23L 33/10; A23L 33/17; A23L 33/18; A23L 33/21; A23L 33/28; A23V 2002/00; A23V 2200/32; A23V 2200/3204; C12Q 1/10; C12Q 1/689; C12Q 1/04; G01N 2800/06; G01N 33/56911; C12N 1/20; A23C 9/12; A23C 9/123; A23C 9/127; A23C 9/1234; A23P 10/30; A23Y 2220/00; A23Y 2300/00; C07H 3/06; C12R 1/01; A61B 1/041; A61B 5/0002; A61B 5/411; A61B 5/42; G16B 20/00; G16B 5/00; G16H 10/40

See application file for complete search history.

(56) References Cited

U.S. PATENT DOCUMENTS 8,557,233 B2  10/2013  MacSharry et al.
9,603,878 B2*  3/2017  Berry .................. A61K 9/0031
9,855,302 B2*  1/2018  Gajewski ............ A61K 35/741

(Continued)

FOREIGN PATENT DOCUMENTS

CN  1863540 A  11/2006
CN  104224851 A  12/2014

(Continued)

OTHER PUBLICATIONS

Appleyard et al., Pretreatment with the probiotic VSL#3 delays transition from inflammation to dysplasia in a rat model of colitis-associated cancer, Am J Physiol Gastrointest Liver Physiol, 301:G1004-G1013 (2011).

(Continued)

*Primary Examiner* — Deborah K Ware
(74) *Attorney, Agent, or Firm* — Foley Hoag LLP

(57) ABSTRACT

Provided herein are methods and compositions related to *Bifidobacterium animalis* ssp. *lactis* useful as therapeutic agents.

28 Claims, 12 Drawing Sheets

Specification includes a Sequence Listing.

(56) References Cited

U.S. PATENT DOCUMENTS

| | | |
|---|---|---|
| 2007/0258953 A1 | 11/2007 | Duncan et al. |
| 2008/0069861 A1 | 3/2008 | Brown et al. |
| 2010/0028449 A1 | 2/2010 | Prakash et al. |
| 2011/0086011 A1 | 4/2011 | Kasper et al. |
| 2016/0143961 A1* | 5/2016 | Berry ............... A61K 9/0031 424/93.3 |
| 2016/0193258 A1* | 7/2016 | Berry ............... A61K 9/0031 424/93.3 |
| 2016/0199424 A1* | 7/2016 | Berry ............... A61K 9/0031 424/93.3 |
| 2016/0223553 A1 | 8/2016 | Sears et al. |
| 2016/0235792 A1* | 8/2016 | Berry ............... A61K 9/0031 |
| 2016/0271188 A1* | 9/2016 | Berry ............... A61K 9/0031 |
| 2016/0354416 A1* | 12/2016 | Gajewski ........... A61K 35/741 |
| 2017/0368110 A1 | 12/2017 | Grant et al. |
| 2018/0015131 A1* | 1/2018 | Gajewski ........... A61K 35/741 |
| 2018/0071344 A1* | 3/2018 | Berry ............... A61K 9/0031 |
| 2018/0147221 A1* | 5/2018 | von Maltzahn ...... A61K 45/06 |
| 2018/0169153 A1* | 6/2018 | Berry ............... A61K 9/0031 |
| 2018/0296582 A1* | 10/2018 | von Maltzahn ...... A61K 45/06 |
| 2019/0091249 A1* | 3/2019 | von Maltzahn ...... A61K 45/06 |
| 2019/0099458 A1 | 4/2019 | Grant et al. |
| 2019/0183942 A1* | 6/2019 | Gajewski ........... A61K 35/741 |
| 2019/0192585 A1* | 6/2019 | Sandy .............. A61K 9/0019 |

FOREIGN PATENT DOCUMENTS

| | | |
|---|---|---|
| EP | 1141235 A2 | 10/2001 |
| EP | 1481681 A1 | 12/2004 |
| EP | 1871400 A2 | 1/2008 |
| EP | 1997907 A1 | 12/2008 |
| EP | 2134835 A2 | 12/2009 |
| EP | 2203551 A1 | 7/2010 |
| EP | 2876167 A1 | 5/2015 |
| JP | 2005097280 A | 4/2005 |
| WO | WO-2003010297 A1 | 2/2003 |
| WO | WO-2005032567 A2 | 4/2005 |
| WO | WO-2008055702 A1 | 5/2008 |
| WO | WO-2008055703 A2 | 5/2008 |
| WO | WO-2009027753 A1 | 3/2009 |
| WO | WO-2011058535 A1 | 5/2011 |
| WO | WO-2012/142605 A1 | 10/2012 |
| WO | WO-2015021936 A1 | 2/2015 |
| WO | WO-2015/038731 A1 | 3/2015 |
| WO | WO-2016118730 A1 | 7/2016 |
| WO | WO-2016/196605 A1 | 12/2016 |
| WO | WO-2019/010255 A1 | 1/2019 |

OTHER PUBLICATIONS

Coakley at al., "Intestinal bifidobacteria that produce trans-9, trans-11 conjugated linoleic acid: a fatty acid with antiproliferative activity against human colon SW480 and HT-29 cancer cells," Nutr Cancer, 65(1):95-102 (2006).

International Search Report and Written Opinion for International Application No. PCT/US2018/040841 dated Dec. 21, 2018.

Kohwi et al., "Antitumor effect of bididobacterium infants in mice," Gann, 69:613-618 (1978).

Rhee et al., "Antitumor activity of *Bifidobacterium* spp. isolated from a healthy Korean," Archieves of Pharmacal Research, 23(5):482-487 (2000).

Rong et al., "Reactivity toward Bifidobacterium longum and Enterococcus hirae demonstrate robust CD8+ T cell response and better prognosis in HBV-related hepatocellular carcinoma," Exp Cell Res, 358(2):352-359 (2017).

Singh et al., "Bifidobacterium longum, a lactic acid-producing intestinal bacterium inhibits colon cancer and modulates the intermediate biomarkers of colon carcinogenesis," Carcinogenesis, 18(4):833-841 (1997).

Sivan et al., "Commensal Bifidobacterium promotes antitumor immunity and facilitates anti-PD-L1 efficacy," Science, 350(6264):1084-1089 (2015).

Tahoun et al., "Capsular polysaccharide inhibits adhesion of Bifidobacterium longum 105-A to enterocyte-like Caco-2 cells and phagocytosis by macrophages," Gut Pathod, 9:27 (2017).

Vetizou et al., "Anticancer immunotherapy by CTLA-4 blockade relies on the gut microbiota," Science, 350(6264):1079-1084 (2015).

Wang et al., "Bifidobacterium can mitigate intestinal immunopathology in the context of CTLA-4 blockade," PNAS, 115(1):157-161 (2018).

Wang et al., "VSL#3 can prevent ulcerative colitis-associated carcinogenesis in mice," World J Gastroenterol, 24(37):4254-4262 (2018).

* cited by examiner

US 10,576,111 B2
                                      1                                                                                  2
         METHOD OF TREATING CANCER USING                       the bacterial formulation comprises at least $1\times10^5$, $5\times10^5$,
          BIFIDOBACTERIUM ANIMALIS SSP. LACTIS                 $1\times10^6$, $2\times10^6$, $3\times10^6$, $4\times10^6$, $5\times10^6$, $6\times10^6$, $7\times10^6$, $8\times10^6$,
                    STRAIN PTA-125097                          $9\times10^6$, $1\times10^7$, $2\times10^7$, $3\times10^7$, $4\times10^7$, $5\times10^7$, $6\times10^7$, $7\times10^7$,
                                                               $8\times10^7$, $9\times10^7$, $1\times10^8$, $2\times10^8$, $3\times10^8$, $4\times10^8$, $5\times10^8$, $6\times10^8$,
                    RELATED APPLICATION                        $7\times10^8$, $8\times10^8$, $9\times10^8$ or $1\times10^9$ colony forming units of
                                                               Bifidobacterium animalis ssp. lactis.
  This application is a continuation of U.S. patent applica-     In certain embodiments, provided herein are bacterial
tion Ser. No. 16/027,684, filed Jul. 5, 2018, which claims the compositions comprising Bifidobacterium animalis ssp. lac-
benefit of priority to U.S. Provisional Patent Application Ser. tis (e.g., a killed bacterium, a live bacterium and/or an
No. 62/528,669, filed Jul. 5, 2017, the entire contents of each attenuated bacterium). In some embodiments, at least 50%,
of which are expressly incorporated herein by reference in     60%, 70%, 80%, 85%, 90%, 90%, 91%, 92%, 93%, 94%,
their entirety.                                                95%, 96%, 97%, 98% or 99% of the bacteria in the bacterial
                                                               composition are Bifidobacterium animalis ssp. lactis. In
                     SEQUENCE LISTING                          some embodiments, the Bifidobacterium animalis ssp. lactis
                                                               is Bifidobacterium animalis ssp. lactis Strain A (ATCC
  The instant application contains a Sequence Listing which   Deposit Number PTA-125097). In some embodiments, the
has been submitted electronically in ASCII format and is      Bifidobacterium animalis ssp. lactis is a strain comprising at
hereby incorporated by reference in its entirety. Said ASCII  least 99% sequence identity (e.g., at least 99.5% sequence
copy, created on Jul. 20, 2018, is named ETB-                 identity, at least 99.6% sequence identity, at least 99.7%
007_01_SL.txt and is 2,528,311 bytes in size.                 sequence identity, at least 99.8% sequence identity, at least
                                                               99.9% sequence identity) to the nucleotide sequence of the
                          SUMMARY                              Bifidobacterium animalis ssp. lactis Strain A. In some
                                                               embodiments, all or substantially all of the bacteria in the
  In certain aspects, provided herein are methods and com-    bacterial formulation are Bifidobacterium animalis ssp. lac-
positions related to the treatment of a cancer in a subject   tis. In some embodiments, the bacterial formulation com-
(e.g., a human subject) comprising administering a bacterial  prises at least $1\times10^5$, $5\times10^5$, $1\times10^6$, $2\times10^6$, $3\times10^6$, $4\times10^6$,
composition comprising Bifidobacterium animalis ssp. lac-     $5\times10^6$, $6\times10^6$, $7\times10^6$, $8\times10^6$, $9\times10^6$, $1\times10^7$, $2\times10^7$, $3\times10^7$,
tis. In some embodiments, the Bifidobacterium animalis ssp.   $4\times10^7$, $5\times10^7$, $6\times10^7$, $7\times10^7$, $8\times10^7$, $9\times10^7$, $1\times10^8$, $2\times10^8$,
lactis is Bifidobacterium animalis ssp. lactis Strain A (ATCC $3\times10^8$, $4\times10^8$, $5\times10^8$, $6\times10^8$, $7\times10^8$, $8\times10^8$, $9\times10^8$ or $1\times10^9$
Deposit Number PTA-125097). In some embodiments, the          colony forming units of Bifidobacterium animalis ssp. lactis.
Bifidobacterium animalis ssp. lactis is a strain comprising at  In some embodiments, the bacterial composition comprise at
least 99% sequence identity (e.g., at least 99.5% sequence    least one strain of Bifidobacterium animalis ssp. lactis
identity, at least 99.6% sequence identity, at least 99.7%    having one gene comprising a nucleotide base change as
sequence identity, at least 99.8% sequence identity, at least identified in Table 6. In some embodiments, the bacterial
99.9% sequence identity) to the nucleotide sequence of the    composition comprise at least one strain of Bifidobacterium
Bifidobacterium animalis ssp. lactis Strain A (Table 1). In   animalis ssp. lactis having 1, 2, 3, 4, 5, 6, 7, 8, 9, 10, 11, 12,
some embodiments, the administration of the bacterial com-    13, 14, 15, 16, 17, 18, 19, 20, 21, 22, 23, 24, 25, 26, 27, 28,
position induces an immune response against a tumor in the    or 29, genes comprising a nucleotide base change as iden-
subject. In some embodiments, the administration of the       tified in Table 6. In some embodiments, the bacterial com-
bacterial composition induces CD3+ immune cell infiltra-      position comprise at least one strain of Bifidobacterium
tion in the subject. In some embodiments, the administration  animalis ssp. lactis having genes comprising all the nucleo-
of the bacterial composition induces WIC Class I upregu-      tide base change as identified in Table 6.
lation at the tumor site. In some embodiments, the admin-       In some embodiments, provided herein are pharmaceuti-
istration of the bacterial composition treats the cancer in the cally active biomasses (PhABs) derived from and/or com-
subject. In some embodiments, the administration augments    prising Bifidobacterium animalis ssp. lactis (e.g., Bifidobac-
a tumor microenvironment in the subject. In some embodi-      terium animalis ssp. lactis Strain A (ATCC Deposit Number
ments, the cancer is a colorectal carcinoma.                  PTA-125097)). In some embodiments, the PhABs comprise
  In certain embodiments, provided herein are methods of     whole cells, fractions of cells, supernatant from fermenta-
treating a subject who has cancer, comprising administering   tion, fractions of supernatant and/or extracellular vesicles
to the subject a bacterial composition comprising Bifidobac-  made from Bifidobacterium animalis ssp. lactis described
terium animalis ssp. lactis (e.g., a killed bacterium, a live herein. In some embodiments, the bacterial compositions
bacterium and/or an attenuated bacterium). In some embodi-    provided herein comprise Bifidobacterium animalis ssp.
ments, the Bifidobacterium animalis ssp. lactis is Bifidobac- lactis PhABs provided herein.
terium animalis ssp. lactis Strain A (ATCC Deposit Number       In some embodiments, the bacterial composition is
PTA-125097). In some embodiments, the Bifidobacterium        administered orally, intravenously, intratumorally, or subcu-
animalis ssp. lactis is a strain comprising at least 99%      taneously. In some embodiments, the bacterial composition
sequence identity (e.g., at least 99.5% sequence identity, at is administered in 2 or more (e.g., 3 or more, 4 or more or
least 99.6% sequence identity, at least 99.7% sequence        5 or more doses). In some embodiments, the administration
identity, at least 99.8% sequence identity, at least 99.9%    to the subject of the two or more doses are separated by at
sequence identity) to the nucleotide sequence of the Bifido-  least 1 hour, 2 hours, 3 hours, 4 hours, 5 hours, 6 hours, 7
bacterium animalis ssp. lactis Strain A. In some embodi-      hours, 8 hours, 9 hours, 10 hours, 11 hours, 12 hours, 13
ments, at least 50%, 60%, 70%, 80%, 85%, 90%, 90%, 91%,       hours, 14 hours, 15 hours, 16 hours, 17 hours, 18 hours, 1
92%, 93%, 94%, 95%, 96%, 97%, 98% or 99% of the               day, 2 days, 3 days, 4 days, 5 days, 6 days, 7 days, 8 days,
bacteria in the bacterial composition are Bifidobacterium     9 days, 10 days, 11 days, 12 days, 13 days, 14 days, 15 days,
animalis ssp. lactis. In some embodiments, all or substan-    16 days, 17 days, 18 days, 19 days, 20 days or 21 days. In
tially all of the bacteria in the bacterial formulation are   some embodiments, a second bacterium is administered as
Bifidobacterium animalis ssp. lactis. In some embodiments,   part of an ecological consortium.

In some embodiments, the method further comprises administering to the subject an antibiotic. In some embodiments, the method further comprises administering to the subject one or more other cancer therapies. In some embodiments, the other cancer therapy is the surgical removal of a tumor, the administration of a chemotherapeutic agent, the administration of radiation therapy, the administration of an antibiotic, the administration of a cancer immunotherapy (e.g., an immune checkpoint inhibitor, a cancer-specific antibody, a cancer vaccine, a primed antigen presenting cell, a cancer-specific T cell, a cancer-specific chimeric antigen receptor (CAR) T cell, an immune activating protein, an adjuvant), and/or the administration of another therapeutic bacterium.

In some embodiments, the subject is a mammal. In some embodiments, the subject is a human. In some embodiments, the subject is a non-human mammal (e.g., a dog, a cat, a cow, a horse, a pig, a donkey, a goat, a camel, a mouse, a rat, a guinea pig, a sheep, a llama, a monkey, a gorilla or a chimpanzee).

In certain embodiments, provided herein is A bioreactor comprising *Bifidobacterium animalis* ssp. *lactis*.

BRIEF DESCRIPTION OF THE FIGURES

FIG. 6A shows inhibition of tumor growth (by volume) by the oral administration of *Bifidobacterium animalis* ssp. *lactis* Strain A in a mouse colorectal carcinoma model.

DETAILED DESCRIPTION

General

Figure 1:
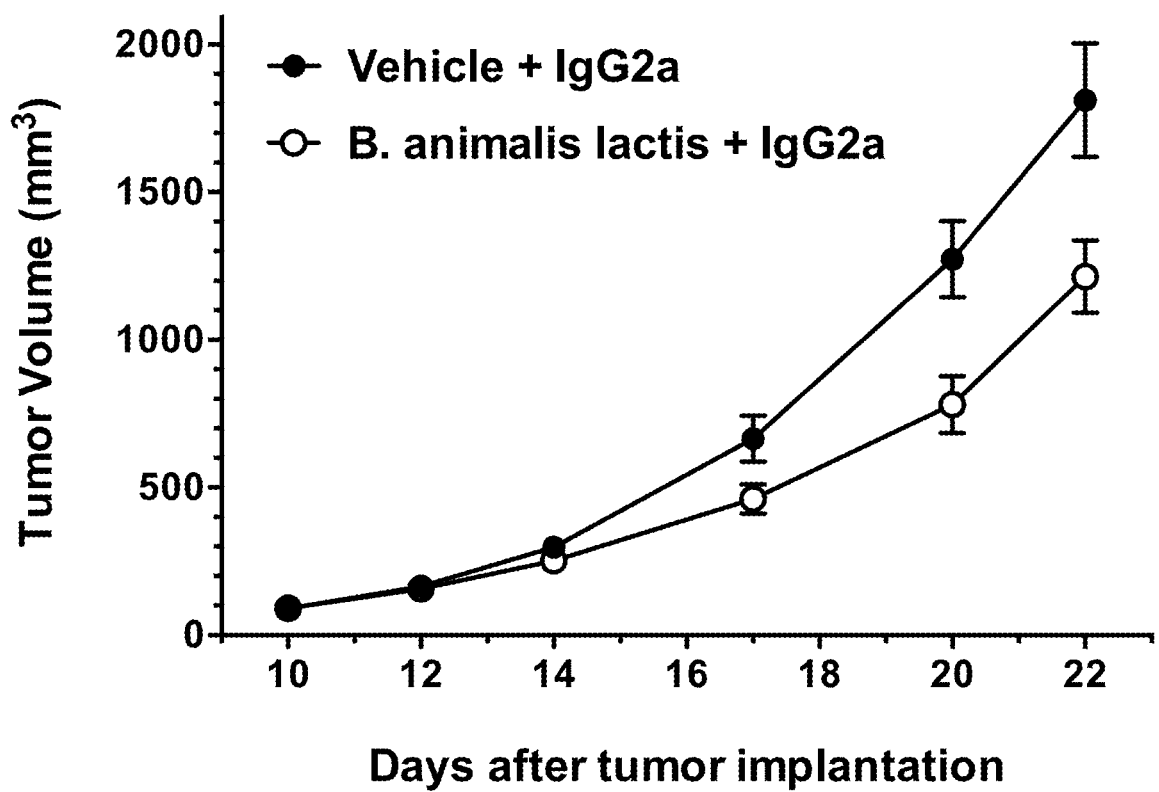
FIG. 1 shows inhibition of tumor growth (by volume) by the oral administration of *Bifidobacterium animalis* ssp. *lactis* Strain A in a mouse colorectal carcinoma model.

In certain aspects, provided herein are bacterial compositions comprising *Bifidobacterium animalis* ssp. *lactis* and methods of treating cancer in a subject comprising administering to the subject a bacterial composition comprising *Bifidobacterium animalis* ssp. *lactis*.

Definitions

"Adjuvant" or "Adjuvant therapy" broadly refers to an agent that affects an immunological or physiological response in a patient or subject. For example, an adjuvant might increase the presence of an antigen over time or to an area of interest like a tumor, help absorb an antigen presenting cell antigen, activate macrophages and lymphocytes and support the production of cytokines. By changing an immune response, an adjuvant might permit a smaller dose of an immune interacting agent to increase the effectiveness or safety of a particular dose of the immune interacting agent. For example, an adjuvant might prevent T cell exhaustion and thus increase the effectiveness or safety of a particular immune interacting agent.

"Administration" broadly refers to a route of administration of a composition to a subject. Examples of routes of administration include oral administration, rectal administration, topical administration, inhalation (nasal) or injection. Administration by injection includes intravenous (IV), intramuscular (IM), intratumoral (IT) and subcutaneous (SC) administration. The pharmaceutical compositions described herein can be administered in any form by any effective route, including but not limited to intratumoral, oral, parenteral, enteral, intravenous, intraperitoneal, topical, transdermal (e.g., using any standard patch), intradermal, ophthalmic, (intra)nasally, local, non-oral, such as aerosol, inhalation, subcutaneous, intramuscular, buccal, sublingual, (trans)rectal, vaginal, intra-arterial, and intrathecal, transmucosal (e.g., sublingual, lingual, (trans)buccal, (trans)urethral, vaginal (e.g., trans- and perivaginally), intravesical, intrapulmonary, intraduodenal, intragastrical, and intrabronchial. In preferred embodiments, the pharmaceutical compositions described herein are administered orally, rectally, intratumorally, topically, intravesically, by injection into or adjacent to a draining lymph node, intravenously, by inhalation or aerosol, or subcutaneously.

As used herein, the term "antibody" may refer to both an intact antibody and an antigen binding fragment thereof. Intact antibodies are glycoproteins that include at least two heavy (H) chains and two light (L) chains inter-connected by disulfide bonds. Each heavy chain includes a heavy chain variable region (abbreviated herein as $V_H$) and a heavy chain constant region. Each light chain includes a light chain variable region (abbreviated herein as $V_L$) and a light chain constant region. The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. The variable regions of the heavy and light chains contain a binding domain that interacts with an antigen. The term "antibody" includes, for example, monoclonal antibodies, polyclonal antibodies, chimeric antibodies, humanized antibodies, human antibodies, multispecific antibodies (e.g., bispecific antibodies), single-chain antibodies and antigen-binding antibody fragments.

The terms "antigen binding fragment" and "antigen-binding portion" of an antibody, as used herein, refers to one or more fragments of an antibody that retain the ability to bind to an antigen. Examples of binding fragments encompassed within the term "antigen-binding fragment" of an antibody include Fab, Fab', F(ab')$_2$, Fv, scFv, disulfide linked Fv, Fd, diabodies, single-chain antibodies, NANOBODIES®, isolated CDRH3, and other antibody fragments that retain at least a portion of the variable region of an intact antibody. These antibody fragments can be obtained using conventional recombinant and/or enzymatic techniques and can be screened for antigen binding in the same manner as intact antibodies.

"Cancer" broadly refers to an uncontrolled, abnormal growth of a host's own cells leading to invasion of surrounding tissue and potentially tissue distal to the initial site of abnormal cell growth in the host. Major classes include carcinomas which are cancers of the epithelial tissue (e.g., skin, squamous cells); sarcomas which are cancers of the connective tissue (e.g., bone, cartilage, fat, muscle, blood vessels, etc.); leukemias which are cancers of blood forming tissue (e.g., bone marrow tissue); lymphomas and myelomas which are cancers of immune cells; and central nervous system cancers which include cancers from brain and spinal tissue. "Cancer(s)," "neoplasm(s)," and "tumor(s)" are used herein interchangeably. As used herein, "cancer" refers to all types of cancer or neoplasm or malignant tumors including leukemias, carcinomas and sarcomas, whether new or recurring. Specific examples of cancers are: carcinomas, sarcomas, myelomas, leukemias, lymphomas and mixed type tumors. Non-limiting examples of cancers are new or recurring cancers of the brain, melanoma, bladder, breast, cervix, colon, head and neck, kidney, lung, non-small cell lung, mesothelioma, ovary, prostate, sarcoma, stomach, uterus and medulloblastoma. Pediatric and adult tumors include, but not limited to, those of bladder, brain, breast, bone, cervix, colon, connective tissue, fat, head and neck, kidney, liver, lung, mesothelium, melanocytes (melanoma), muscle, ovary, pancreas, prostate, stomach, small intestine, and uterus The term "decrease" or "deplete" means a change, such that the difference is, depending on circumstances, at least 10%, 20%, 30%, 40%, 50%, 60%, 70%, 80%, 90%, $\frac{1}{100}$, $\frac{1}{1000}$, $\frac{1}{10,000}$, $\frac{1}{100,000}$, $\frac{1}{1,000,000}$ or undetectable after treatment when compared to a pre-treatment state.

The term "ecological consortium" is a group of bacteria which trades metabolites and positively co-regulates one another, in contrast to two bacteria which induce host synergy through activating complementary host pathways for improved efficacy.

The term "epitope" means a protein determinant capable of specific binding to an antibody. Epitopes usually consist of chemically active surface groupings of molecules such as amino acids or sugar side chains. Certain epitopes can be defined by a particular sequence of amino acids to which an antibody is capable of binding.

The term "gene" is used broadly to refer to any nucleic acid associated with a biological function. The term "gene" applies to a specific genomic sequence, as well as to a cDNA or an mRNA encoded by that genomic sequence.

"Identity" as between nucleic acid sequences of two nucleic acid molecules can be determined as a percentage of identity using known computer algorithms such as the "FASTA" program, using for example, the default parameters as in Pearson et al. (1988) Proc. Natl. Acad. Sci. USA 85:2444 (other programs include the GCG program package (Devereux, J., et al., Nucleic Acids Research 12(I):387 (1984)), BLASTP, BLASTN, FASTA Atschul, S. F., et al., J Molec Biol 215:403 (1990); Guide to Huge Computers, Mrtin J. Bishop, ed., Academic Press, San Diego, 1994, and Carillo et al. (1988) SIAM J Applied Math 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison, Wis.)).

"Immunotherapy" is treatment that uses a subject's immune system to treat cancer and includes, for example, checkpoint inhibitors, cancer vaccines, cytokines, cell therapy, CAR-T cells, and dendritic cell therapy.

The term "increase" means a change, such that the difference is, depending on circumstances, at least 10%, 20%, 30%, 40%, 50%, 60%, 70%, 80%, 90%, 2-fold, 4-fold, 10-fold, 100-fold, $10^3$ fold, $10^4$ fold, $10^5$ fold, $10^6$ fold, and/or $10^7$ fold greater after treatment when compared to a pre-treatment state. Properties that may be increased include immune cells, bacterial cells, stromal cells, myeloid derived suppressor cells, fibroblasts, metabolites, and cytokines.

"Innate immune agonists" or "immuno-adjuvants" are small molecules, proteins, or other agents that specifically target innate immune receptors including Toll-Like Receptors, NOD receptors, STING Pathway components. For example, LPS is a TLR-4 agonist that is bacterially derived or synthesized and aluminum can be used as an immune stimulating adjuvant. immuno-adjuvants are a specific class of broader adjuvant or adjuvant therapy.

The term "isolated" or "enriched" encompasses a microbe, bacteria or other entity or substance that has been (1) separated from at least some of the components with which it was associated when initially produced (whether in nature or in an experimental setting), and/or (2) produced, prepared, purified, and/or manufactured by the hand of man. Isolated microbes may be separated from at least about 10%, about 20%, about 30%, about 40%, about 50%, about 60%, about 70%, about 80%, about 90%, or more of the other components with which they were initially associated. In some embodiments, isolated microbes are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. The terms "purify," "purifying" and "purified" refer to a microbe or other material that has been separated from at least some of the components with which it was associated either when initially produced or generated (e.g., whether in nature or in an experimental setting), or during any time after its initial production. A microbe or a microbial population may be considered purified if it is isolated at or after production, such as from a material or environment containing the microbe or microbial population, and a purified microbe or microbial population may contain other materials up to about 10%, about 20%, about 30%, about 40%, about 50%, about 60%, about 70%, about 80%, about 90%, or above about 90% and still be considered "isolated." In some embodiments, purified microbes or microbial population are more than about 80%, about 85%, about 90%, about 91%, about 92%, about 93%, about 94%, about 95%, about 96%, about 97%, about 98%, about 99%, or more than about 99% pure. In the instance of microbial compositions provided herein, the one or more microbial types present in the composition can be independently purified from one or more other microbes produced and/or present in the material or environment containing the microbial type. Microbial compositions and the microbial components thereof are generally purified from residual habitat products.

As used herein, a gene is "overexpressed" in a bacteria if it is expressed at a higher level in an engineered bacteria under at least some conditions than it is expressed by a wild-type bacteria of the same species under the same conditions. Similarly, a gene is "underexpressed" in a bacteria if it is expressed at a lower level in an engineered bacteria under at least some conditions than it is expressed by a wild-type bacteria of the same species under the same conditions.

The terms "polynucleotide" and "nucleic acid" are used interchangeably. They refer to a polymeric form of nucleotides of any length, either deoxyribonucleotides or ribonucleotides, or analogs thereof. Polynucleotides may have any three-dimensional structure, and may perform any function. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. A polynucleotide may be further modified, such as by conjugation with a labeling component. In all nucleic acid sequences provided herein, U nucleotides are interchangeable with T nucleotides.

"Operational taxonomic units" and "OTU(s)" refer to a terminal leaf in a phylogenetic tree and is defined by a nucleic acid sequence, e.g., the entire genome, or a specific genetic sequence, and all sequences that share sequence identity to this nucleic acid sequence at the level of species. In some embodiments the specific genetic sequence may be the 16S sequence or a portion of the 16S sequence. In other embodiments, the entire genomes of two entities are sequenced and compared. In another embodiment, select regions such as multilocus sequence tags (MLST), specific genes, or sets of genes may be genetically compared. For 16S, OTUs that share ≥97% average nucleotide identity across the entire 16S or some variable region of the 16S are considered the same OTU. See e.g. Claesson M J, Wang Q, O'Sullivan O, Greene-Diniz R, Cole J R, Ross R P, and O'Toole P W. 2010. Comparison of two next-generation sequencing technologies for resolving highly complex microbiota composition using tandem variable 16S rRNA gene regions. Nucleic Acids Res 38: e200. Konstantinidis K T, Ramette A, and Tiedje J M. 2006. The bacterial species definition in the genomic era. Philos Trans R Soc Lond B Biol Sci 361: 1929-1940. For complete genomes, MLSTs, specific genes, other than 16S, or sets of genes OTUs that share ≥95% average nucleotide identity are considered the same OTU. See e.g., Achtman M, and Wagner M. 2008. Microbial diversity and the genetic nature of microbial species. Nat. Rev. Microbiol. 6: 431-440. Konstantinidis K T, Ramette A, and Tiedje J M. 2006. The bacterial species definition in the genomic era. Philos Trans R Soc Lond B Biol Sci 361: 1929-1940. OTUs are frequently defined by comparing sequences between organisms. Generally, sequences with less than 95% sequence identity are not considered to form part of the same OTU. OTUs may also be characterized by any combination of nucleotide markers or genes, in particular highly conserved genes (e.g., "housekeeping" genes), or a combination thereof. Operational Taxonomic Units (OTUs) with taxonomic assignments made to, e.g., genus, species, and phylogenetic clade are provided herein.

As used herein, "specific binding" refers to the ability of an antibody to bind to a predetermined antigen or the ability of a polypeptide to bind to its predetermined binding partner. Typically, an antibody or polypeptide specifically binds to its predetermined antigen or binding partner with an affinity corresponding to a $K_D$ of about $10^{-7}$ M or less, and binds to the predetermined antigen/binding partner with an affinity (as expressed by $K_D$) that is at least 10 fold less, at least 100 fold less or at least 1000 fold less than its affinity for binding to a non-specific and unrelated antigen/binding partner (e.g., BSA, casein). Alternatively, specific binding applies more broadly to a two component system where one component is a protein, lipid, or carbohydrate or combination thereof and engages with the second component which is a protein, lipid, carbohydrate or combination thereof in a specific way.

The terms "subject" or "patient" refers to any animal. A subject or a patient described as "in need thereof" refers to one in need of a treatment for a disease. Mammals (i.e., mammalian animals) include humans, laboratory animals (e.g., primates, rats, mice), livestock (e.g., cows, sheep, goats, pigs), and household pets (e.g., dogs, cats, rodents). For example, the subject may be a non-human mammal including but not limited to of a dog, a cat, a cow, a horse, a pig, a donkey, a goat, a camel, a mouse, a rat, a guinea pig, a sheep, a llama, a monkey, a gorilla or a chimpanzee. The subject or patient may be healthy, or may be suffering from a neoplasm at any developmental stage, wherein any of the stages are either caused by or opportunistically supported of a cancer associated or causative pathogen, or may be at risk of developing a neoplasm, or transmitting to others a cancer associated or cancer causative pathogen. In some embodiments patients have lung cancer, bladder cancer, prostate cancer, ovarian cancer, and/or melanoma. The patients may have tumors that show enhanced macropinocytosis with the underlying genomics of this process including Ras activation. In other embodiments patients suffer from other cancers. In some embodiments, the subject has undergone a cancer therapy.

"Strain" refers to a member of a bacterial species with a genetic signature such that it may be differentiated from closely-related members of the same bacterial species. The genetic signature may be the absence of all or part of at least one gene, the absence of all or part of at least on regulatory region (e.g., a promoter, a terminator, a riboswitch, a ribosome binding site), the absence ("curing") of at least one native plasmid, the presence of at least one recombinant gene, the presence of at least one mutated gene, the presence of at least one foreign gene (a gene derived from another species), the presence at least one mutated regulatory region (e.g., a promoter, a terminator, a riboswitch, a ribosome binding site), the presence of at least one non-native plasmid, the presence of at least one antibiotic resistance cassette, or a combination thereof. Genetic signatures between different strains may be identified by PCR amplification optionally followed by DNA sequencing of the genomic region(s) of interest or of the whole genome. In the case in which one strain (compared with another of the same species) has gained or lost antibiotic resistance or gained or lost a biosynthetic capability (such as an auxotrophic strain), strains may be differentiated by selection or counter-selection using an antibiotic or nutrient/metabolite, respectively.

As used herein, the term "treating" a disease in a subject or "treating" a subject having or suspected of having a disease refers to subjecting the subject to a pharmaceutical treatment, e.g., the administration of one or more agents, such that at least one symptom of the disease is decreased or prevented from worsening. Thus, in one embodiment, "treating" refers inter alia to delaying progression, expediting remission, inducing remission, augmenting remission, speeding recovery, increasing efficacy of or decreasing resistance to alternative therapeutics, or a combination thereof. In certain embodiments, a cancer is treated if the subject experiences a reduction in tumor size, a reduced number of tumors, a reduction in tumor growth, a reduction in cancer metastasis and/or a reduced number of total cancer cells following treatment than would be expected in the absence of treatment.

Bacteria

In certain aspects, provided herein are bacterial compositions comprising *Bifidobacterium animalis* ssp. *lactis* (e.g., an effective amount of *Bifidobacterium animalis* ssp. *lactis*) and methods of using a bacterial composition comprising *Bifidobacterium animalis* ssp. *lactis*. In some embodiments, the *Bifidobacterium animalis* ssp. *lactis* is *Bifidobacterium animalis* ssp. *lactis* Strain A (ATCC Deposit Number PTA-125097). In some embodiments, the bacterial composition comprise a PhAB made from or comprising a *Bifidobacterium animalis* ssp. *lactis* described herein. In some embodiments, the *Bifidobacterium animalis* ssp. *lactis* is a strain comprising at least 99% sequence identity (e.g., at least 99.5% sequence identity, at least 99.6% sequence identity, at least 99.7% sequence identity, at least 99.8% sequence identity, at least 99.9% sequence identity) to the nucleotide sequence of the *Bifidobacterium animalis* ssp. *lactis* Strain A.

Under the terms of the Budapest Treaty on the International Recognition of the Deposit of Microorganisms for the Purpose of Patent Procedure, the *Bifidobacterium animalis* ssp. *lactis* Strain A was deposited on Apr. 27, 2018, with the American Type Culture Collection (ATCC) of 10801 University Boulevard, Manassas, Va. 20110-2209 USA and was assigned ATCC Accession Number PTA-125097.

Applicant represents that the ATCC is a depository affording permanence of the deposit and ready accessibility thereto by the public if a patent is granted. All restrictions on the availability to the public of the material so deposited will be irrevocably removed upon the granting of a patent. The material will be available during the pendency of the patent application to one determined by the Commissioner to be entitled thereto under 37 CFR 1.14 and 35 U.S.C. 122. The deposited material will be maintained with all the care necessary to keep it viable and uncontaminated for a period of at least five years after the most recent request for the furnishing of a sample of the deposited plasmid, and in any case, for a period of at least thirty (30) years after the date of deposit or for the enforceable life of the patent, whichever period is longer. Applicant acknowledges its duty to replace the deposit should the depository be unable to furnish a sample when requested due to the condition of the deposit.

In some embodiments, the bacteria described herein are modified to improve colonization and/or engraftment in the mammalian gastrointestinal tract (e.g., modified metabolism, such as improved mucin degradation, enhanced competition profile, increased motility, increased adhesion to gut epithelial cells, modified chemotaxis). In some embodiments, the bacteria described herein are modified to enhance their immunomodulatory and/or therapeutic effect (e.g., either alone or in combination with another therapeutic agent). In some embodiments, the bacteria described herein are modified to enhance immune activation (e.g., through modified production of polysaccharides, pili, fimbriae, adhesins, outer membrane vesicles). In some embodiments, the bacteria described herein are modified to improve bacterial manufacturing (e.g., higher oxygen tolerance, improved freeze-thaw tolerance, shorter generation times).

In certain embodiments, the *Bifidobacterium animalis* ssp. *lactis* is grown in Reinforced *Clostridium* medium (RCM medium) (ATCC 2107 or medium from other manufacturer), Lactobacilli MRS medium (LMRS medium), and/or Bifido agar. Alternatively, *Bifidobactrium animalis* ssp. *lactis* is grown using RCM medium ATCC 1053 and/or Trypticase soy agar/broth with defibrimated sheep blood ATCC 260 per the manufacturer's instructions.

The nucleotide sequence of the *Bifidobacterium animalis* ssp. *lactis* Strain A is shown in Table 1.

Lengthy table referenced here

US10576111-20200303-T00001

Please refer to the end of the specification for access instructions.

Bacterial Compositions

In certain aspects, provided herein are bacterial compositions comprising *Bifidobacterium animalis* ssp. *lactis*. In some embodiments, the *Bifidobacterium animalis* ssp. *lactis* is *Bifidobacterium animalis* ssp. *lactis* Strain A (ATCC Deposit Number PTA-125097). In some embodiments, the bacterial composition comprise a PhAB made from or comprising a *Bifidobacterium animalis* ssp. *lactis* described herein. In some embodiments, the *Bifidobacterium animalis* ssp. *lactis* is a strain comprising at least 99% sequence identity (e.g., at least 99.5% sequence identity, at least 99.6% sequence identity, at least 99.7% sequence identity, at least 99.8% sequence identity, at least 99.9% sequence identity) to the nucleotide sequence of the *Bifidobacterium animalis* ssp. *lactis* Strain A. In some embodiments, the bacterial formulation comprises a bacterium and/or a combination of bacteria described herein and a pharmaceutically acceptable carrier.

In certain embodiments, at least 50%, 55%, 60%, 65%, 70%, 75%, 80%, 85%, 90%, 91%, 92%, 93%, 94%, 95%, 96%, 97%, 98% or 99% of the bacteria in the bacterial composition are *Bifidobacterium animalis* ssp. *lactis*. In certain embodiments, substantially all of the bacteria in the bacterial composition are *Bifidobacterium animalis* ssp. *lactis*. In certain embodiments, the bacterial composition comprises at least $1 \times 10^3$ colony forming units (CFUs), $1 \times 10^4$ colony forming units (CFUs), $1 \times 10^5$ colony forming units (CFUs), $5 \times 10^5$ colony forming units (CFUs), $1 \times 10^6$ colony forming units (CFUs), $2 \times 10^6$ colony forming units (CFUs), $3 \times 10^6$ colony forming units (CFUs), $4 \times 10^6$ colony forming units (CFUs), $5 \times 10^6$ colony forming units (CFUs), $6 \times 10^6$ colony forming units (CFUs), $7 \times 10^6$ colony forming units (CFUs), $8 \times 10^6$ colony forming units (CFUs), $9 \times 10^6$ colony forming units (CFUs), $1 \times 10^7$ colony forming units (CFUs), $2 \times 10^7$ colony forming units (CFUs), $3 \times 10^7$ colony forming units (CFUs), $4 \times 10^7$ colony forming units (CFUs), $5 \times 10^7$ colony forming units (CFUs), $6 \times 10^7$ colony forming units (CFUs), $7 \times 10^7$ colony forming units (CFUs), $8 \times 10^7$ colony forming units (CFUs), $9 \times 10^7$ colony forming units (CFUs), $1 \times 10^8$ colony forming units (CFUs), $2 \times 10^8$ colony forming units (CFUs), $3 \times 10^8$ colony forming units (CFUs), $4 \times 10^8$ colony forming units (CFUs), $5 \times 10^8$ colony forming units (CFUs), $6 \times 10^8$ colony forming units (CFUs), $7 \times 10^8$ colony forming units (CFUs), $8 \times 10^8$ colony forming units (CFUs), $9 \times 10^8$ colony forming units (CFUs), $1 \times 10^9$ colony forming units (CFUs), $5 \times 10^9$ colony forming units (CFUs), $1 \times 10^{10}$ colony forming units (CFUs) $5 \times 10^{10}$ colony forming units (CFUs), $1 \times 10^{11}$ colony forming units (CFUs) $5 \times 10^{11}$ colony forming units (CFUs), $1 \times 10^{12}$ colony forming units (CFUs) $5 \times 10^{12}$ colony forming units (CFUs), $1 \times 10^{13}$ colony forming units (CFUs) of *Bifidobacterium animalis* ssp. *lactis*.

In some embodiments, Probiotic formulations containing *Bifidobacterium animalis* ssp. *lactis* are provided as encapsulated, enteric coated, or powder forms, with doses ranging up to $10^{11}$ cfu (e.g., up to $10^{10}$ cfu). In some embodiments, the composition comprises $5 \times 10^{11}$ cfu of *Bifidobacterium animalis* ssp. *lactis* and 10% (w/w) corn starch in a capsule. The capsule is enteric coated for duodenal release at pH5.5. In some embodiments, the capsule is enteric coated for duodenal release at pH 5.5. In some embodiments, the composition comprises a powder of freeze-dried *Bifidobacterium animalis* ssp. *lactis* which is deemed "Qualified Presumption of Safety" (QPS) status. In some embodiments, the composition is stable at frozen or refrigerated temperature.

Methods for producing microbial compositions may include three main processing steps. The steps are: organism banking, organism production, and preservation. In certain embodiments, a sample that contains an abundance of *Bifidobacterium animalis* ssp. *lactis* may be cultured by avoiding an isolation step.

For banking, the strains included in the microbial composition may be (1) isolated directly from a specimen or taken from a banked stock, (2) optionally cultured on a nutrient agar or broth that supports growth to generate viable biomass, and (3) the biomass optionally preserved in multiple aliquots in long-term storage.

In embodiments using a culturing step, the agar or broth may contain nutrients that provide essential elements and specific factors that enable growth. An example would be a medium composed of 20 g/L glucose, 10 g/L yeast extract, 10 g/L soy peptone, 2 g/L citric acid, 1.5 g/L sodium phosphate monobasic, 100 mg/L ferric ammonium citrate, 80 mg/L magnesium sulfate, 10 mg/L hemin chloride, 2 mg/L calcium chloride, 1 mg/L menadione. Another example would be a medium composed of 10 g/L beef extract, 10 g/L peptone, 5 g/L sodium chloride, 5 g/L dextrose, 3 g/L yeast extract, 3 g/L sodium acetate, 1 g/L soluble starch, and 0.5 g/L L-cysteine HCl, at pH 6.8. A variety of microbiological media and variations are well known in the art (e.g., R. M. Atlas, *Handbook of Microbiological Media* (2010) CRC Press). Culture media can be added to the culture at the start, may be added during the culture, or may be intermittently/continuously flowed through the culture. The strains in the bacterial composition may be cultivated alone, as a subset of the microbial composition, or as an entire collection comprising the microbial composition. As an example, a first strain may be cultivated together with a second strain in a mixed continuous culture, at a dilution rate lower than the maximum growth rate of either cell to prevent the culture from washing out of the cultivation.

The inoculated culture is incubated under favorable conditions for a time sufficient to build biomass. For microbial compositions for human use this is often at 37° C. temperature, pH, and other parameter with values similar to the normal human niche. The environment may be actively controlled, passively controlled (e.g., via buffers), or allowed to drift. For example, for anaerobic bacterial compositions, an anoxic/reducing environment may be employed. This can be accomplished by addition of reducing agents such as cysteine to the broth, and/or stripping it of oxygen. As an example, a culture of a bacterial composition may be grown at 37° C., pH 7, in the medium above, pre-reduced with 1 g/L cysteine-HCl.

When the culture has generated sufficient biomass, it may be preserved for banking. The organisms may be placed into a chemical milieu that protects from freezing (adding 'cryoprotectants'), drying ('lyoprotectants'), and/or osmotic shock ('osmoprotectants'), dispensing into multiple (optionally identical) containers to create a uniform bank, and then treating the culture for preservation. Containers are generally impermeable and have closures that assure isolation from the environment. Cryopreservation treatment is accomplished by freezing a liquid at ultra-low temperatures (e.g., at or below −80° C.). Dried preservation removes water from the culture by evaporation (in the case of spray drying or 'cool drying') or by sublimation (e.g., for freeze drying, spray freeze drying). Removal of water improves long-term microbial composition storage stability at temperatures elevated above cryogenic conditions. If the microbial composition comprises, for example, spore forming species and results in the production of spores, the final composition may be purified by additional means such as density gradient centrifugation and preserved using the techniques [?]described above[?]. Microbial composition banking may be done by culturing and preserving the strains individually, or by mixing the strains together to create a combined bank. As an example of cryopreservation, a microbial composition culture may be harvested by centrifugation to pellet the cells from the culture medium, the supernatant decanted and replaced with fresh culture broth containing 15% glycerol. The culture can then be aliquoted into 1 mL cryotubes, sealed, and placed at −80° C. for long-term viability retention. This procedure achieves acceptable viability upon recovery from frozen storage.

Microbial production may be conducted using similar culture steps to banking, including medium composition and culture conditions described above. It may be conducted at larger scales of operation, especially for clinical development or commercial production. At larger scales, there may be several subcultivations of the microbial composition prior to the final cultivation. At the end of cultivation, the culture is harvested to enable further formulation into a dosage form for administration. This can involve concentration, removal of undesirable medium components, and/or introduction into a chemical milieu that preserves the microbial composition and renders it acceptable for administration via the chosen route. For example, a microbial composition may be cultivated to a concentration of $10^{10}$ CFU/mL, then concentrated 20-fold by tangential flow microfiltration; the spent medium may be exchanged by diafiltering with a preservative medium consisting of 2% gelatin, 100 mM trehalose, and 10 mM sodium phosphate buffer. The suspension can then be freeze-dried to a powder and titrated.

After drying, the powder may be blended to an appropriate potency, and mixed with other cultures and/or a filler such as microcrystalline cellulose for consistency and ease of handling, and the bacterial composition formulated as provided herein.

In certain aspects, provided are bacterial compositions for administration subjects. In some embodiments, the bacterial compositions are combined with additional active and/or inactive materials in order to produce a final product, which may be in single dosage unit or in a multi-dose format.

In some embodiments, the composition comprises at least one carbohydrate. A "carbohydrate" refers to a sugar or polymer of sugars. The terms "saccharide," "polysaccharide," "carbohydrate," and "oligosaccharide" may be used interchangeably. Most carbohydrates are aldehydes or ketones with many hydroxyl groups, usually one on each carbon atom of the molecule. Carbohydrates generally have the molecular formula $C_nH_{2n}O_n$. A carbohydrate may be a monosaccharide, a disaccharide, trisaccharide, oligosaccharide, or polysaccharide. The most basic carbohydrate is a monosaccharide, such as glucose, sucrose, galactose, mannose, ribose, arabinose, xylose, and fructose. Disaccharides are two joined monosaccharides. Exemplary disaccharides include sucrose, maltose, cellobiose, and lactose. Typically, an oligosaccharide includes between three and six monosaccharide units (e.g., raffinose, stachyose), and polysaccharides include six or more monosaccharide units. Exemplary polysaccharides include starch, glycogen, and cellulose. Carbohydrates may contain modified saccharide units such as 2'-deoxyribose wherein a hydroxyl group is removed, 2'-fluororibose wherein a hydroxyl group is replaced with a fluorine, or N-acetylglucosamine, a nitrogen-containing form of glucose (e.g., 2'-fluororibose, deoxyribose, and hexose). Carbohydrates may exist in many different forms, for example, conformers, cyclic forms, acyclic forms, stereoisomers, tautomers, anomers, and isomers.

In some embodiments, the composition comprises at least one lipid. As used herein, a "lipid" includes fats, oils, triglycerides, cholesterol, phospholipids, fatty acids in any form including free fatty acids. Fats, oils and fatty acids can be saturated, unsaturated (cis or trans) or partially unsaturated (cis or trans). In some embodiments the lipid comprises at least one fatty acid selected from lauric acid (12:0), myristic acid (14:0), palmitic acid (16:0), palmitoleic acid (16:1), margaric acid (17:0), heptadecenoic acid (17:1), stearic acid (18:0), oleic acid (18:1), linoleic acid (18:2), linolenic acid (18:3), octadecatetraenoic acid (18:4), arachidic acid (20:0), eicosenoic acid (20:1), eicosadienoic acid (20:2), eicosatetraenoic acid (20:4), eicosapentaenoic acid (20:5) (EPA), docosanoic acid (22:0), docosenoic acid (22:1), docosapentaenoic acid (22:5), docosahexaenoic acid (22:6) (DHA), and tetracosanoic acid (24:0). In some embodiments the composition comprises at least one modified lipid, for example a lipid that has been modified by cooking.

In some embodiments, the composition comprises at least one supplemental mineral or mineral source. Examples of minerals include, without limitation: chloride, sodium, calcium, iron, chromium, copper, iodine, zinc, magnesium, manganese, molybdenum, phosphorus, potassium, and selenium. Suitable forms of any of the foregoing minerals include soluble mineral salts, slightly soluble mineral salts, insoluble mineral salts, chelated minerals, mineral complexes, non-reactive minerals such as carbonyl minerals, and reduced minerals, and combinations thereof.

In some embodiments, the composition comprises at least one supplemental vitamin. The at least one vitamin can be fat-soluble or water soluble vitamins. Suitable vitamins include but are not limited to vitamin C, vitamin A, vitamin E, vitamin B12, vitamin K, riboflavin, niacin, vitamin D, vitamin B6, folic acid, pyridoxine, thiamine, pantothenic acid, and biotin. Suitable forms of any of the foregoing are salts of the vitamin, derivatives of the vitamin, compounds having the same or similar activity of the vitamin, and metabolites of the vitamin.

In some embodiments, the composition comprises an excipient. Non-limiting examples of suitable excipients include a buffering agent, a preservative, a stabilizer, a binder, a compaction agent, a lubricant, a dispersion enhancer, a disintegration agent, a flavoring agent, a sweetener, and a coloring agent.

In some embodiments, the excipient is a buffering agent. Non-limiting examples of suitable buffering agents include sodium citrate, magnesium carbonate, magnesium bicarbonate, calcium carbonate, and calcium bicarbonate.

In some embodiments, the excipient comprises a preservative. Non-limiting examples of suitable preservatives include antioxidants, such as alpha-tocopherol and ascorbate, and antimicrobials, such as parabens, chlorobutanol, and phenol.

In some embodiments, the composition comprises a binder as an excipient. Non-limiting examples of suitable binders include starches, pregelatinized starches, gelatin, polyvinylpyrolidone, cellulose, methylcellulose, sodium carboxymethylcellulose, ethylcellulose, polyacrylamides, polyvinyloxoazolidone, polyvinylalcohols, $C_{12}$-$C_{18}$ fatty acid alcohol, polyethylene glycol, polyols, saccharides, oligosaccharides, and combinations thereof.

In some embodiments, the composition comprises a lubricant as an excipient. Non-limiting examples of suitable lubricants include magnesium stearate, calcium stearate, zinc stearate, hydrogenated vegetable oils, sterotex, polyoxyethylene monostearate, talc, polyethyleneglycol, sodium benzoate, sodium lauryl sulfate, magnesium lauryl sulfate, and light mineral oil.

In some embodiments, the composition comprises a dispersion enhancer as an excipient. Non-limiting examples of suitable dispersants include starch, alginic acid, polyvinylpyrrolidones, guar gum, kaolin, bentonite, purified wood cellulose, sodium starch glycolate, isoamorphous silicate, and microcrystalline cellulose as high HLB emulsifier surfactants.

In some embodiments, the composition comprises a disintegrant as an excipient. In some embodiments the disintegrant is a non-effervescent disintegrant. Non-limiting examples of suitable non-effervescent disintegrants include starches such as corn starch, potato starch, pregelatinized and modified starches thereof, sweeteners, clays, such as bentonite, microcrystalline cellulose, alginates, sodium starch glycolate, gums such as agar, guar, locust bean, karaya, pectin, and tragacanth. In some embodiments the disintegrant is an effervescent disintegrant. Non-limiting examples of suitable effervescent disintegrants include sodium bicarbonate in combination with citric acid, and sodium bicarbonate in combination with tartaric acid.

In some embodiments, the bacterial formulation comprises an enteric coating or micro encapsulation. In certain embodiments, the enteric coating or micro encapsulation improves targeting to a desired region of the gastrointestinal tract. For example, in certain embodiments, the bacterial composition comprises an enteric coating and/or microcapsules that dissolves at a pH associated with a particular region of the gastrointestinal tract. In some embodiments, the enteric coating and/or microcapsules dissolve at a pH of about 5.5-6.2 to release in the duodenum, at a pH value of about 7.2-7.5 to release in the ileum, and/or at a pH value of about 5.6-6.2 to release in the colon. Exemplary enteric coatings and microcapsules are described, for example, in U.S. Pat. Pub. No. 2016/0022592, which is hereby incorporated by reference in its entirety.

In some embodiments, the composition is a food product (e.g., a food or beverage) such as a health food or beverage, a food or beverage for infants, a food or beverage for pregnant women, athletes, senior citizens or other specified group, a functional food, a beverage, a food or beverage for specified health use, a dietary supplement, a food or beverage for patients, or an animal feed. Specific examples of the foods and beverages include various beverages such as juices, refreshing beverages, tea beverages, drink preparations, jelly beverages, and functional beverages; alcoholic beverages such as beers; carbohydrate-containing foods such as rice food products, noodles, breads, and pastas; paste products such as fish hams, sausages, paste products of seafood; retort pouch products such as curries, food dressed with a thick starchy sauces, and Chinese soups; soups; dairy products such as milk, dairy beverages, ice creams, cheeses, and yogurts; fermented products such as fermented soybean pastes, yogurts, fermented beverages, and pickles; bean products; various confectionery products, including biscuits, cookies, and the like, candies, chewing gums, gummies, cold desserts including jellies, cream caramels, and frozen desserts; instant foods such as instant soups and instant soy-bean soups; microwavable foods; and the like. Further, the examples also include health foods and beverages prepared in the forms of powders, granules, tablets, capsules, liquids, pastes, and jellies.

In certain embodiments, the bacteria disclosed herein are administered in conjunction with a prebiotic to the subject. Prebiotics are carbohydrates which are generally indigestible by a host animal and are selectively fermented or metabolized by bacteria. Prebiotics may be short-chain carbohydrates (e.g., oligosaccharides) and/or simple sugars (e.g., mono- and di-saccharides) and/or mucins (heavily glycosylated proteins) that alter the composition or metabolism of a microbiome in the host. The short chain carbohydrates are also referred to as oligosaccharides, and usually contain from 2 or 3 and up to 8, 9, 10, 15 or more sugar moieties. When prebiotics are introduced to a host, the prebiotics affect the bacteria within the host and do not directly affect the host. In certain aspects, a prebiotic composition can selectively stimulate the growth and/or activity of one of a limited number of bacteria in a host. Prebiotics include oligosaccharides such as fructooligosaccharides (FOS) (including inulin), galactooligosaccharides (GOS), trans-galactooligosaccharides, xylooligosaccharides (XOS), chitooligosaccharides (COS), soy oligosaccharides (e.g., stachyose and raffinose) gentiooligosaccharides, isomaltooligosaccharides, mannooligosaccharides, maltooligosaccharides and mannanoligosaccharides. Oligosaccharides are not necessarily single components, and can be mixtures containing oligosaccharides with different degrees of oligomerization, sometimes including the parent disaccharide and the monomeric sugars. Various types of oligosaccharides are found as natural components in many common foods, including fruits, vegetables, milk, and honey. Specific examples of oligosaccharides are lactulose, lactosucrose, palatinose, glycosyl sucrose, guar gum, gum Arabic, tagalose, amylose, amylopectin, pectin, xylan, and cyclodextrins. Prebiotics may also be purified or chemically or enzymatically synthesized.

Production of PhABs

In certain aspects, the PhABs described herein can be prepared using any method known in the art.

In some embodiments, the PhABs described herein are prepared by fractionation. Bacterial cells and/or supernatants from cultured bacteria cells are fractionated into various pharmacologically active biomass (PhABs) and/or products derived therefrom. Bacterial cells and/or supernatants are fractionated using materials and methods known in the art (see e.g. Sandrini et al. Fractionation by ultracentrifugation of gram negative cytoplasmic and membrane proteins. 2014. Bio-Protocol. 4(21); Scholler et al. Protoplast and cytoplasmic membrane preparations from Streptococcus sanguis and Streptococcus mutans. 1983. J Gen Micro. 129: 3271-3279; Thein et al. Efficient subfractionation of gram-negative bacteria for proteomics studies. 2010. Am Chem Society. 9: 6135-6147; Hobb et al. Evaluation of procedures for outer membrane isolation from Campylobacter jejuni. 2009. 155(Pt. 3): 979-988).

Additionally, PhABs obtained by methods provided herein may be further purified by size based column chromatography, by affinity chromatography, and by gradient ultracentrifugation, using methods that may include, but are not limited to, use of a sucrose gradient or Optiprep gradient. Briefly, using a sucrose gradient method, if ammonium sulfate precipitation or ultracentrifugation were used to concentrate the filtered supernatants, pellets are resuspended in 60% sucrose, 30 mM Tris, pH 8.0. If filtration was used to concentrate the filtered supernatant, the concentrate is buffer exchanged into 60% sucrose, 30 mM Tris, pH 8.0, using an Amicon Ultra column. Samples are applied to a 35-60% discontinuous sucrose gradient and centrifuged at 200,000×g for 3-24 hours at 4° C. Briefly, using an Optiprep gradient method, if ammonium sulfate precipitation or ultracentrifugation were used to concentrate the filtered supernatants, pellets are resuspended in 35% Optiprep in PBS. In some embodiments, if filtration was used to concentrate the filtered supernatant, the concentrate is diluted using 60% Optiprep to a final concentration of 35% Optiprep. Samples are applied to a 35-60% discontinuous sucrose gradient and centrifuged at 200,000×g for 3-24 hours at 4° C.

In some embodiments, to confirm sterility and isolation of the PhAB preparations, PhABs are serially diluted onto agar medium used for routine culture of the bacteria being tested, and incubated using routine conditions. Non-sterile preparations are passed through a 0.22 um filter to exclude intact cells. To further increase purity, isolated PhABs may be DNase or proteinase K treated.

In some embodiments, for preparation of PhABs used for in vivo injections, purified PhABs are processed as described previously (G. Norheim, et al. *PLoS ONE*. 10(9): e0134353 (2015)). Briefly, after sucrose gradient centrifugation, bands containing PhABs are resuspended to a final concentration of 50 μg/mL in a solution containing 3% sucrose or other solution suitable for in vivo injection known to one skilled in the art. This solution may also contain adjuvant, for example aluminum hydroxide at a concentration of 0-0.5% (w/v).

In certain embodiments, to make samples compatible with further testing (e.g. to remove sucrose prior to TEM imaging or in vitro assays), samples are buffer exchanged into PBS or 30 mM Tris, pH 8.0 using filtration (e.g. Amicon Ultra columns), dialysis, or ultracentrifugation (200,000×g, ≥3 hours, 4° C.) and resuspension.

In some embodiments, the sterility of the PhAB preparations can be confirmed by plating a portion of the PhABs onto agar medium used for standard culture of the bacteria used in the generation of the PhABs and incubating using standard conditions.

In some embodiments select PhABs are isolated and enriched by chromatography and binding surface moieties on PhABs. In other embodiments, select PhABs are isolated and/or enriched by fluorescent cell sorting by methods using affinity reagents, chemical dyes, recombinant proteins or other methods known to one skilled in the art.

Administration

In certain aspects, provided herein is a method of delivering a bacterium and/or a bacterial composition described herein to a subject. In some embodiments of the methods provided herein, the bacteria are administered in conjunction with the administration of a cancer therapeutic. In some embodiments, the bacteria is co-formulated in a pharmaceutical composition with the cancer therapeutic. In some embodiments, the bacteria is co-administered with the cancer therapeutic. In some embodiments, the cancer therapeutic is administered to the subject before administration of the bacteria (e.g., about 1, 2, 3, 4, 5, 6, 7, 8, 9, 10, 15, 20, 25, 30, 35, 40, 45, 50 or 55 minutes before, about 1, 2, 3, 4, 5, 6, 7, 8, 9, 10, 11, 12, 13, 14, 15, 16, 17, 18, 19, 20, 21, 22 or 23 hours before, or about 1, 2, 3, 4, 5, 6, 7, 8, 9, 10, 11, 12, 13 or 14 days before). In some embodiments, the cancer therapeutic is administered to the subject after administration of the bacteria (e.g., about 1, 2, 3, 4, 5, 6, 7, 8, 9, 10, 15, 20, 25, 30, 35, 40, 45, 50 or 55 minutes after, about 1, 2, 3, 4, 5, 6, 7, 8, 9, 10, 11, 12, 13, 14, 15, 16, 17, 18, 19, 20, 21, 22 or 23 hours after, or about 1, 2, 3, 4, 5, 6, 7, 8, 9, 10, 11, 12, 13 or 14 days after). In some embodiments, the same mode of delivery is used to deliver both the bacteria and the cancer therapeutic. In some embodiments different modes of delivery are used to administer the bacteria and the cancer therapeutic. For example, in some embodiments, the bacteria is administered orally while the cancer therapeutic is administered via injection (e.g., an intravenious, intramuscular and/or intratumoral injection).

In certain embodiments, the pharmaceutical compositions, dosage forms, and kits described herein can be administered in conjunction with any other conventional anticancer treatment, such as, for example, radiation therapy and surgical resection of the tumor. These treatments may be applied as necessary and/or as indicated and may occur before, concurrent with or after administration of the pharmaceutical compositions, dosage forms, and kits described herein.

The dosage regimen can be any of a variety of methods and amounts, and can be determined by one skilled in the art according to known clinical factors. As is known in the medical arts, dosages for any one patient can depend on many factors, including the subject's species, size, body surface area, age, sex, immunocompetence, and general health, the particular microorganism to be administered, duration and route of administration, the kind and stage of the disease, for example, tumor size, and other compounds such as drugs being administered concurrently. In addition to the above factors, such levels can be affected by the infectivity of the microorganism, and the nature of the microorganism, as can be determined by one skilled in the art. In the present methods, appropriate minimum dosage levels of microorganisms can be levels sufficient for the microorganism to survive, grow and replicate in a tumor or metastasis. The methods of treatment described herein may be suitable for the treatment of a primary tumor, a secondary tumor or metastasis, as well as for recurring tumors or cancers. The dose of the pharmaceutical compositions described herein may be appropriately set or adjusted in accordance with the dosage form, the route of administration, the degree or stage of a target disease, and the like. For example, the general effective dose of the agents may range between 0.01 mg/kg body weight/day and 1000 mg/kg body weight/day, between 0.1 mg/kg body weight/day and 1000 mg/kg body weight/day, 0.5 mg/kg body weight/day and 500 mg/kg body weight/day, 1 mg/kg body weight/day and 100 mg/kg body weight/day, or between 5 mg/kg body weight/day and 50 mg/kg body weight/day. The effective dose may be 0.01, 0.05, 0.1, 0.5, 1, 2, 3, 5, 10, 20, 30, 40, 50, 60, 70, 80, 90, 100, 200, 500, or 1000 mg/kg body weight/day or more, but the dose is not limited thereto.

In some embodiments, the dose administered to a subject is sufficient to prevent cancer, delay its onset, or slow or stop its progression or prevent a relapse of a cancer. One skilled in the art will recognize that dosage will depend upon a variety of factors including the strength of the particular compound employed, as well as the age, species, condition, and body weight of the subject. The size of the dose will also be determined by the route, timing, and frequency of administration as well as the existence, nature, and extent of any adverse side-effects that might accompany the administration of a particular compound and the desired physiological effect.

Suitable doses and dosage regimens can be determined by conventional range-finding techniques known to those of ordinary skill in the art. Generally, treatment is initiated with smaller dosages, which are less than the optimum dose of the compound. Thereafter, the dosage is increased by small increments until the optimum effect under the circumstances is reached. An effective dosage and treatment protocol can be determined by routine and conventional means, starting e.g., with a low dose in laboratory animals and then increasing the dosage while monitoring the effects, and systematically varying the dosage regimen as well. Animal studies are commonly used to determine the maximal tolerable dose ("MTD") of bioactive agent per kilogram weight. Those skilled in the art regularly extrapolate doses for efficacy, while avoiding toxicity, in other species, including humans.

In accordance with the above, in therapeutic applications, the dosages of the active agents used in accordance with the invention vary depending on the active agent, the age, weight, and clinical condition of the recipient patient, and the experience and judgment of the clinician or practitioner administering the therapy, among other factors affecting the selected dosage. Generally, the dose should be sufficient to result in slowing, and preferably regressing, the growth of the tumors and most preferably causing complete regression of the cancer.

Separate administrations can include any number of two or more administrations (e.g., doses), including two, three, four, five or six administrations. One skilled in the art can readily determine the number of administrations to perform, or the desirability of performing one or more additional administrations, according to methods known in the art for monitoring therapeutic methods and other monitoring methods provided herein. In some embodiments, the doses may be separated by at least 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 days or 1, 2, 3, or 4 weeks. Accordingly, the methods provided herein include methods of providing to the subject one or more administrations of a bacterium, where the number of administrations can be determined by monitoring the subject, and, based on the results of the monitoring, determining whether or not to provide one or more additional administrations. Deciding on whether or not to provide one or more additional administrations can be based on a variety of monitoring results, including, but not limited to, indication of tumor growth or inhibition of tumor growth, appearance of new metastases or inhibition of metastasis, the subject's anti-bacterium antibody titer, the subject's anti-tumor antibody titer, the overall health of the subject and/or the weight of the subject.

The time period between administrations can be any of a variety of time periods. The time period between administrations can be a function of any of a variety of factors, including monitoring steps, as described in relation to the number of administrations, the time period for a subject to mount an immune response and/or the time period for a subject to clear the bacteria from normal tissue. In one example, the time period can be a function of the time period for a subject to mount an immune response; for example, the time period can be more than the time period for a subject to mount an immune response, such as more than about one week, more than about ten days, more than about two weeks, or more than about a month; in another example, the time period can be less than the time period for a subject to mount an immune response, such as less than about one week, less than about ten days, less than about two weeks, or less than about a month. In another example, the time period can be a function of the time period for a subject to clear the bacteria from normal tissue; for example, the time period can be more than the time period for a subject to clear the bacteria from normal tissue, such as more than about a day, more than about two days, more than about three days, more than about five days, or more than about a week.

In some embodiments, the delivery of a cancer therapeutic in combination with the bacteria described herein reduces the adverse effects and/or improves the efficacy of the cancer therapeutic.

The effective dose of a cancer therapeutic described herein is the amount of the therapeutic agent that is effective to achieve the desired therapeutic response for a particular patient, composition, and mode of administration, with the least toxicity to the patient. The effective dosage level can be identified using the methods described herein and will depend upon a variety of pharmacokinetic factors including the activity of the particular compositions administered, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors well known in the medical arts. In general, an effective dose of a cancer therapy will be the amount of the therapeutic agent which is the lowest dose effective to produce a therapeutic effect. Such an effective dose will generally depend upon the factors described above.

The toxicity of a cancer therapy is the level of adverse effects experienced by the subject during and following treatment. Adverse events associated with cancer therapy toxicity include, but are not limited to, abdominal pain, acid indigestion, acid reflux, allergic reactions, alopecia, anaphylaxis, anemia, anxiety, lack of appetite, arthralgias, asthenia, ataxia, azotemia, loss of balance, bone pain, bleeding, blood clots, low blood pressure, elevated blood pressure, difficulty breathing, bronchitis, bruising, low white blood cell count, low red blood cell count, low platelet count, cardiotoxicity, cystitis, hemorrhagic cystitis, arrhythmias, heart valve disease, cardiomyopathy, coronary artery disease, cataracts, central neurotoxicity, cognitive impairment, confusion, conjunctivitis, constipation, coughing, cramping, cystitis, deep vein thrombosis, dehydration, depression, diarrhea, dizziness, dry mouth, dry skin, dyspepsia, dyspnea, edema, electrolyte imbalance, esophagitis, fatigue, loss of fertility, fever, flatulence, flushing, gastric reflux, gastroesophageal reflux disease, genital pain, granulocytopenia, gynecomastia, glaucoma, hair loss, hand-foot syndrome, headache, hearing loss, heart failure, heart palpitations, heartburn, hematoma, hemorrhagic cystitis, hepatotoxicity, hyperamylasemia, hypercalcemia, hyperchloremia, hyperglycemia, hyperkalemia, hyperlipasemia, hypermagnesemia, hypernatremia, hyperphosphatemia, hyperpigmentation, hypertriglyceridemia, hyperuricemia, hypoalbuminemia, hypocalcemia, hypochloremia, hypoglycemia, hypokalemia, hypomagnesemia, hyponatremia, hypophosphatemia, impotence, infection, injection site reactions, insomnia, iron deficiency, itching, joint pain, kidney failure, leukopenia, liver dysfunction, memory loss, menopause, mouth sores, mucositis, muscle pain, myalgias, myelosuppression, myocarditis, neutropenic fever, nausea, nephrotoxicity, neutropenia, nosebleeds, numbness, ototoxicity, pain, palmar-plantar erythrodysesthesia, pancytopenia, pericarditis, peripheral neuropathy, pharyngitis, photophobia, photosensitivity, pneumonia, pneumonitis, proteinuria, pulmonary embolus, pulmonary fibrosis, pulmonary toxicity, rash, rapid heart beat, rectal bleeding, restlessness, rhinitis, seizures, shortness of breath, sinusitis, thrombocytopenia, tinnitus, urinary tract infection, vaginal bleeding, vaginal dryness, vertigo, water retention, weakness, weight loss, weight gain, and xerostomia. In general, toxicity is acceptable if the benefits to the subject achieved through the therapy outweigh the adverse events experienced by the subject due to the therapy.

In some embodiments, the administration of the bacterial composition treats the cancer. In some embodiments, the bacterial composition induces an anti-tumor immune response in the subject.

Therapeutic Agents

In certain aspects, the methods provided herein include the administration to a subject of a bacterium and/or a bacterial composition described herein (e.g., a *Bifidobacterium animalis* ssp. *lactis*-containing bacterial composition) either alone or in combination with another cancer therapeutic. The other cancer therapeutic may include e.g., surgical resection, radiotherapy, or a cancer therapeutic agent. In some embodiments, the bacterial composition and the other cancer therapy can be administered to the subject in any order. In some embodiments, the bacterial composition and the other cancer therapy are administered conjointly.

In some embodiments the bacterium is administered to the subject before the cancer therapeutic is administered (e.g., at least 1, 2, 3, 4, 5, 6, 7, 8, 9, 10, 11, 12, 13, 14, 15, 16, 17, 18, 19, 20, 21, 22, 23 or 24 hours before or at least 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 days before). In some embodiments the bacterium is administered to the subject after the cancer therapeutic is administered (e.g., at least 1, 2, 3, 4, 5, 6, 7, 8, 9, 10, 11, 12, 13, 14, 15, 16, 17, 18, 19, 20, 21, 22, 23 or 24 hours after or at least 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 days after). In some embodiments, the bacterium and the cancer therapeutic are administered to the subject simultaneously or nearly simultaneously (e.g., administrations occur within an hour of each other). In some embodiments, the subject is administered an antibiotic before the bacterium is administered to the subject (e.g., at least 1, 2, 3, 4, 5, 6, 7, 8, 9, 10, 11, 12, 13, 14, 15, 16, 17, 18, 19, 20, 21, 22, 23 or 24 hours before or at least 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 days before), In some embodiments, the subject is administered an antibiotic after the bacterium is administered to the subject (e.g., at least 1, 2, 3, 4, 5, 6, 7, 8, 9, 10, 11, 12, 13, 14, 15, 16, 17, 18, 19, 20, 21, 22, 23 or 24 hours before or at least 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 days after). In some embodiments, the bacterium and the antibiotic are administered to the subject simultaneously or nearly simultaneously (e.g., administrations occur within an hour of each other).

In certain embodiments, the subject may undergo surgery. Types of surgery include but are not limited to preventative, diagnostic or staging, curative and palliative surgery. Curative surgery is a cancer treatment that may be used in conjunction with other therapies, such as the treatment of the present invention, chemotherapy, radiotherapy, hormonal therapy, gene therapy, immunotherapy and/or alternative therapies.

Curative surgery includes resection in which all or part of cancerous tissue is physically removed, excised, and/or destroyed. Tumor resection refers to physical removal of at least part of a tumor. In addition to tumor resection, treatment by surgery includes laser surgery, cryosurgery, electrosurgery, and microscopically controlled surgery (Mohs' surgery). Upon excision of part of all of cancerous cells, tissue, or tumor, a cavity may be formed in the body.

In certain embodiments, the subject may undergo radiation therapy. Radiation therapy includes the administration or application of a radiotherapeutic agents and factors including but not limited to In addition to trays, UV-irradiation, microwaves, electronic emissions, and radioisotopes. The localized tumor site may be irradiated, including by one or more the above described forms of radiations. All of these factors may effect a broad range of damage DNA, on the precursors of DNA, the replication and repair of DNA, and the assembly and maintenance of chromosomes.

Dosage ranges for X-rays range from daily doses of 50 to 200 roentgens for prolonged periods of time (3 to 4 weeks), to single doses of 2000 to 6000 roentgens. Dosage ranges for radioisotopes vary widely, and depend on the half-life of the isotope, the strength and type of radiation emitted, and the uptake by the neoplastic cells.

In certain aspects, the methods provided herein further comprise administering another cancer therapeutic to the subject.

In some embodiments, the cancer therapeutic is a chemotherapeutic agent. Examples of such chemotherapeutic agents include, but are not limited to, alkylating agents such as thiotepa and cyclophosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gammall and calicheamicin omegall; dynemicin, including dynemicin A; bisphosphonates, such as clodronate; an esperamicin; as well as neocarzinostatin chromophore and related chromoprotein enediyne antibiotic chromophores, aclacinomysins, actinomycin, authrarnycin, azaserine, bleomycins, cactinomycin, carabicin, caminomycin, carzinophilin, chromomycinis, dactinomycin, daunorubicin, detorubicin, 6-diazo-5-oxo-L-norleucine, doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK polysaccharide complex); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., paclitaxel and doxetaxel; chlorambucil; gemcitabine; 6-thioguanine; mercaptopurine; methotrexate; platinum coordination complexes such as cisplatin, oxaliplatin and carboplatin; vinblastine; platinum; etoposide (VP-16); ifosfamide; mitoxantrone; vincristine; vinorelbine; novantrone; teniposide; edatrexate; daunomycin; aminopterin; xeloda; ibandronate; irinotecan (e.g., CPT-11); topoisomerase inhibitor RFS 2000; difluoromethylomithine (DMFO); retinoids such as retinoic acid; capecitabine; and pharmaceutically acceptable salts, acids or derivatives of any of the above.

In some embodiments, the cancer therapeutic is a cancer immunotherapy agent. Immunotherapy refers to a treatment that uses a subject's immune system to treat cancer, e.g., checkpoint inhibitors, cancer vaccines, cytokines, cell therapy, CAR-T cells, and dendritic cell therapy. Non-limiting examples of immunotherapies are checkpoint inhibitors include Nivolumab (BMS, anti-PD-1), Pembrolizumab (Merck, anti-PD-1), Ipilimumab (BMS, anti-CTLA-4), MEDI4736 (AstraZeneca, anti-PD-L1), and MPDL3280A (Roche, anti-PD-L1). Other immunotherapies may be tumor vaccines, such as Gardail, Cervarix, BCG, sipulencel-T, Gp100:209-217, AGS-003, DCVax-L, Algenpantucel-L, Tergenpantucel-L, TG4010, ProstAtak, Prostvac-V/R-TRICOM, Rindopepimul, E75 peptide acetate, IMA901, POL-103A, Belagenpumatucel-L, GSK1572932A, MDX-1279, GV1001, and Tecemotide. Immunotherapy may be administered via injection (e.g., intravenously, intratumorally, subcutaneously, or into lymph nodes), but may also be administered orally, topically, or via aerosol. Immunotherapies may comprise adjuvants such as cytokines.

In some embodiments, the immunotherapy agent is an immune checkpoint inhibitor. Immune checkpoint inhibition broadly refers to inhibiting the checkpoints that cancer cells can produce to prevent or downregulate an immune response. Examples of immune checkpoint proteins include, but are not limited to, CTLA4, PD-1, PD-L1, PD-L2, A2AR, B7-H3, B7-H4, BTLA, KIR, LAG3, TIM-3 or VISTA. Immune checkpoint inhibitors can be antibodies or antigen binding fragments thereof that bind to and inhibit an immune checkpoint protein. Examples of immune checkpoint inhibitors include, but are not limited to, nivolumab, pembrolizumab, pidilizumab, AMP-224, AMP-514, STI-A1110, TSR-042, RG-7446, BMS-936559, MEDI-4736, MSB-0020718C, AUR-012 and STI-A1010. In some embodiments, the cancer immunotherapy includes administering an additional immune checkpoint inhibitor (e.g., administering 2, 3, 4, or 5, immune checkpoint inhibitors) to the subject In certain embodiments, immune checkpoint inhibitors can be an inhibitory nucleic acid molecule (e.g., an siRNA molecule, an shRNA molecule or an antisense RNA molecule) that inhibits expression of an immune checkpoint protein that inhibits expression of an immune checkpoint protein.

In some embodiments, the immune checkpoint inhibitor is a siRNA molecule. Such siRNA molecules should include a region of sufficient homology to the target region, and be of sufficient length in terms of nucleotides, such that the siRNA molecule down-regulate target RNA (e.g., RNA of an immune checkpoint protein). The term "ribonucleotide" or "nucleotide" can, in the case of a modified RNA or nucleotide surrogate, also refer to a modified nucleotide, or surrogate replacement moiety at one or more positions. It is not necessary that there be perfect complementarity between the siRNA molecule and the target, but the correspondence must be sufficient to enable the siRNA molecule to direct sequence-specific silencing, such as by RNAi cleavage of the target RNA. In some embodiments, the sense strand need only be sufficiently complementary with the antisense strand to maintain the overall double-strand character of the molecule.

In addition, an siRNA molecule may be modified or include nucleoside surrogates. Single stranded regions of an siRNA molecule may be modified or include nucleoside surrogates, e.g., the unpaired region or regions of a hairpin structure, e.g., a region which links two complementary regions, can have modifications or nucleoside surrogates. Modification to stabilize one or more 3'- or 5'-terminus of an siRNA molecule, e.g., against exonucleases, or to favor the antisense siRNA agent to enter into RISC are also useful. Modifications can include C3 (or C6, C7, C12) amino linkers, thiol linkers, carboxyl linkers, non-nucleotidic spacers (C3, C6, C9, C12, abasic, triethylene glycol, hexaethylene glycol), special biotin or fluorescein reagents that come as phosphoramidites and that have another DMT-protected hydroxyl group, allowing multiple couplings during RNA synthesis.

Each strand of an siRNA molecule can be equal to or less than 35, 30, 25, 24, 23, 22, 21, or 20 nucleotides in length. In some embodiments, the strand is at least 19 nucleotides in length. For example, each strand can be between 21 and 25 nucleotides in length. In some embodiments, siRNA agents have a duplex region of 17, 18, 19, 29, 21, 22, 23, 24, or 25 nucleotide pairs, and one or more overhangs, such as one or two 3' overhangs, of 2-3 nucleotides.

In some embodiments, the immune checkpoint inhibitor is a shRNA molecule. A "small hairpin RNA" or "short hairpin RNA" or "shRNA" includes a short RNA sequence that makes a tight hairpin turn that can be used to silence gene expression via RNA interference. The shRNAs provided herein may be chemically synthesized or transcribed from a transcriptional cassette in a DNA plasmid. The shRNA hairpin structure is cleaved by the cellular machinery into siRNA, which is then bound to the RNA-induced silencing complex (RISC).

In some embodiments, shRNAs are about 15-60, 15-50, or 15-40 (duplex) nucleotides in length, about 15-30, 15-25, or 19-25 (duplex) nucleotides in length, or are about 20-24, 21-22, or 21-23 (duplex) nucleotides in length (e.g., each complementary sequence of the double-stranded shRNA is 15-60, 15-50, 15-40, 15-30, 15-25, or 19-25 nucleotides in length, or about 20-24, 21-22, or 21-23 nucleotides in length, and the double-stranded shRNA is about 15-60, 15-50, 15-40, 15-30, 15-25, or 19-25 base pairs in length, or about 18-22, 19-20, or 19-21 base pairs in length). shRNA duplexes may comprise 3' overhangs of about 1 to about 4 nucleotides or about 2 to about 3 nucleotides on the antisense strand and/or 5'-phosphate termini on the sense strand. In some embodiments, the shRNA comprises a sense strand and/or antisense strand sequence of from about 15 to about 60 nucleotides in length (e.g., about 15-60, 15-55, 15-50, 15-45, 15-40, 15-35, 15-30, or 15-25 nucleotides in length), or from about 19 to about 40 nucleotides in length (e.g., about 19-40, 19-35, 19-30, or 19-25 nucleotides in length), or from about 19 to about 23 nucleotides in length (e.g., 19, 20, 21, 22, or 23 nucleotides in length).

Non-limiting examples of shRNA include a double-stranded polynucleotide molecule assembled from a single-stranded molecule, where the sense and antisense regions are linked by a nucleic acid-based or non-nucleic acid-based linker; and a double-stranded polynucleotide molecule with a hairpin secondary structure having self-complementary sense and antisense regions. In some embodiments, the sense and antisense strands of the shRNA are linked by a loop structure comprising from about 1 to about 25 nucleotides, from about 2 to about 20 nucleotides, from about 4 to about 15 nucleotides, from about 5 to about 12 nucleotides, or 1, 2, 3, 4, 5, 6, 7, 8, 9, 10, 11, 12, 13, 14, 15, 16, 17, 18, 19, 20, 21, 22, 23, 24, 25, or more nucleotides.

Additional embodiments related to the shRNAs, as well as methods of designing and synthesizing such shRNAs, are described in U.S. patent application publication number 2011/0071208, the disclosure of which is herein incorporated by reference in its entirety for all purposes.

In some embodiments, the immune checkpoint inhibitor is an antisense oligonucleotide compounds that inhibits expression of an immune checkpoint protein. In certain embodiments, the degree of complementarity between the target sequence and antisense targeting sequence is sufficient to form a stable duplex. The region of complementarity of the antisense oligonucleotides with the target RNA sequence may be as short as 8-11 bases, but can be 12-15 bases or more, e.g., 10-40 bases, 12-30 bases, 12-25 bases, 15-25 bases, 12-20 bases, or 15-20 bases, including all integers in between these ranges. An antisense oligonucleotide of about 14-15 bases is generally long enough to have a unique complementary sequence.

In certain embodiments, antisense oligonucleotides may be 100% complementary to the target sequence, or may include mismatches, e.g., to improve selective targeting of allele containing the disease-associated mutation, as long as a heteroduplex formed between the oligonucleotide and target sequence is sufficiently stable to withstand the action of cellular nucleases and other modes of degradation which may occur in vivo. Hence, certain oligonucleotides may have about or at least about 70% sequence complementarity, e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence complementarity, between the oligonucleotide and the target sequence. Oligonucleotide backbones that are less susceptible to cleavage by nucleases are discussed herein. Mismatches, if present, are typically less destabilizing toward the end regions of the hybrid duplex than in the middle. The number of mismatches allowed will depend on the length of the oligonucleotide, the percentage of G:C base pairs in the duplex, and the position of the mismatch(es) in the duplex, according to well understood principles of duplex stability.

The inhibitory nucleic acid molecule can be prepared, for example, by chemical synthesis, in vitro transcription, or digestion of long dsRNA by Rnase III or Dicer. These can be introduced into cells by transfection, electroporation, or other methods known in the art. See Hannon, GJ, 2002, RNA Interference, Nature 418: 244-251; Bernstein E et al., 2002, The rest is silence. RNA 7: 1509-1521; Hutvagner G et al., RNAi: Nature abhors a double-strand. Curr. Opin. Genetics & Development 12: 225-232; Brummelkamp, 2002, A system for stable expression of short interfering RNAs in mammalian cells. Science 296: 550-553; Lee N S, Dohjima T, Bauer G, Li H, Li M-J, Ehsani A, Salvaterra P, and Rossi J. (2002). Expression of small interfering RNAs targeted against HIV-1 rev transcripts in human cells. Nature Biotechnol. 20:500-505; Miyagishi M, and Taira K. (2002). U6-promoter-driven siRNAs with four uridine 3' overhangs efficiently suppress targeted gene expression in mammalian cells. Nature Biotechnol. 20:497-500; Paddison P J, Caudy A A, Bernstein E, Hannon G J, and Conklin D S. (2002). Short hairpin RNAs (shRNAs) induce sequence-specific silencing in mammalian cells. Genes & Dev. 16:948-958; Paul C P, Good P D, Winer I, and Engelke D R. (2002). Effective expression of small interfering RNA in human cells. Nature Biotechnol. 20:505-508; Sui G, Soohoo C, Affar E-B, Gay F, Shi Y, Forrester W C, and Shi Y. (2002). A DNA vector-based RNAi technology to suppress gene expression in mammalian cells. Proc. Natl. Acad. Sci. USA 99(6):5515-5520; Yu J-Y, DeRuiter S L, and Turner D L. (2002). RNA interference by expression of short-interfering RNAs and hairpin RNAs in mammalian cells. Proc. Natl. Acad. Sci. USA 99(9):6047-6052.

In the present methods, the inhibitory nucleic acid molecule can be administered to the subject, for example, as naked nucleic acid, in combination with a delivery reagent, and/or as a nucleic acid comprising sequences that express an interfering nucleic acid molecule. In some embodiments the nucleic acid comprising sequences that express the interfering nucleic acid molecules are delivered within vectors, e.g. plasmid, viral and bacterial vectors. Any nucleic acid delivery method known in the art can be used in the methods described herein. Suitable delivery reagents include, but are not limited to, e.g., the Mirus Transit TKO lipophilic reagent; lipofectin; lipofectamine; cellfectin; polycations (e.g., polylysine), atelocollagen, nanoplexes and liposomes. The use of atelocollagen as a delivery vehicle for nucleic acid molecules is described in Minakuchi et al. Nucleic Acids Res., 32(13):e109 (2004); Hanai et al. Ann NY Acad Sci., 1082:9-17 (2006); and Kawata et al. Mol Cancer Ther., 7(9):2904-12 (2008); each of which is incorporated herein in their entirety. Exemplary interfering nucleic acid delivery systems are provided in U.S. Pat. Nos. 8,283,461, 8,313,772, 8,501,930. 8,426,554, 8,268,798 and 8,324,366, each of which is hereby incorporated by reference in its entirety.

In some embodiments, the immunotherapy agent is an antibody or antigen binding fragment thereof that, for example, binds to a cancer-associated antigen. Examples of cancer-associated antigens include, but are not limited to, adipophilin, AIM-2, ALDH1A1, alpha-actinin-4, alpha-fetoprotein ("AFP"), ARTC1, B-RAF, BAGE-1, BCLX (L), BCR-ABL fusion protein b3a2, beta-catenin, BING-4, CA-125, CALCA, carcinoembryonic antigen ("CEA"), CASP-5, CASP-8, CD274, CD45, Cdc27, CDK12, CDK4, CDKN2A, CEA, CLPP, COA-1, CPSF, CSNK1A1, CTAG1, CTAG2, cyclin D1, Cyclin-A1, dek-can fusion protein, DKK1, EFTUD2, Elongation factor 2, ENAH (hMena), Ep-CAM, EpCAM, EphA3, epithelial tumor antigen ("ETA"), ETV6-AML1 fusion protein, EZH2, FGF5, FLT3-ITD, FN1, G250/MN/CAIX, GAGE-1,2,8, GAGE-3, 4,5,6,7, GAS7, glypican-3, GnTV, gp100/Pme117, GPNMB, HAUS3, Hepsin, HER-2/neu, HERV-K-MEL, HLA-A11, HLA-A2, HLA-DOB, hsp70-2, IDO1, IGF2B3, IL13Ralpha2, Intestinal carboxyl esterase, K-ras, Kallikrein 4, KIF20A, KK-LC-1, KKLC1, KM-HN-1, KMHN1 also known as CCDC110, LAGE-1, LDLR-fucosyltransferaseAS fusion protein, Lengsin, M-CSF, MAGE-A1, MAGE-A10, MAGE-A12, MAGE-A2, MAGE-A3, MAGE-A4, MAGE-A6, MAGE-A9, MAGE-C1, MAGE-C2, malic enzyme, mammaglobin-A, MART2, MATN, MC1R, MCSP, mdm-2, ME1, Melan-A/MART-1, Meloe, Midkine, MMP-2, MMP-7, MUC1, MUCSAC, mucin, MUM-1, MUM-2, MUM-3, Myosin, Myosin class I, N-raw, NA88-A, neo-PAP, NFYC, NY-BR-1, NY-ESO-1/LAGE-2, OA1, OGT, OS-9, P polypeptide, p53, PAP, PAX5, PBF, pml-RARalpha fusion protein, polymorphic epithelial mucin ("PEM"), PPP1R3B, PRAME, PRDX5, PSA, PSMA, PTPRK, RAB38/NY-MEL-1, RAGE-1, RBAF600, RGS5, RhoC, RNF43, RU2AS, SAGE, secernin 1, SIRT2, SNRPD1, SOX10, Sp17, SPA17, SSX-2, SSX-4, STEAP1, survivin, SYT-SSX1 or -SSX2 fusion protein, TAG-1, TAG-2, Telomerase, TGF-betaRII, TPBG, TRAG-3, Triosephosphate isomerase, TRP-1/gp75, TRP-2, TRP2-INT2, tyrosinase, tyrosinase ("TYR"), VEGF, WT1, XAGE-1b/GAGED2a. In some embodiments, the antigen is a neo-antigen.

In some embodiments, the immunotherapy agent is a cancer vaccine and/or a component of a cancer vaccine (e.g., an antigenic peptide and/or protein). The cancer vaccine can be a protein vaccine, a nucleic acid vaccine or a combination thereof. For example, in some embodiments, the cancer vaccine comprises a polypeptide comprising an epitope of a cancer-associated antigen. In some embodiments, the cancer vaccine comprises a nucleic acid (e.g., DNA or RNA, such as mRNA) that encodes an epitope of a cancer-associated antigen. In some embodiemnts, the nucleic acid is a vector (e.g., a bacterial vector, viral vector). Examples of bacterial vectors include, but are not limited to, *Mycobacterium bovis* (BCG), *Salmonella Typhimurium* ssp., *Salmonella Typhi* ssp., *Clostridium* sp. spores, *Escherichia coli* Nissle 1917, *Escherichia coli* K-12/LLO, *Listeria monocytogenes*, and *Shigella flexneri*. Examples of viral vectors include, but are not limited to, vaccinia, adenovirus, RNA viruses, and replication-defective avipox, replication-defective fowlpox, replication-defective canarypox, replication-defective MVA and replication-defective adenovirus.

In some embodiments, the cancer immunotherapy comprises administration of an antigen presenting cell (APC) primed with a cancer-specific antigen. In some embodiments, the APC is a dendritic cell, a macrophage or a B cell.

Examples of cancer-associated antigens include, but are not limited to, adipophilin, AIM-2, ALDH1A1, alpha-actinin-4, alpha-fetoprotein ("AFP"), ARTC1, B-RAF, BAGE-1, BCLX (L), BCR-ABL fusion protein b3a2, beta-catenin, BING-4, CA-125, CALCA, carcinoembryonic antigen ("CEA"), CASP-5, CASP-8, CD274, CD45, Cdc27, CDK12, CDK4, CDKN2A, CEA, CLPP, COA-1, CPSF, CSNK1A1, CTAG1, CTAG2, cyclin D1, Cyclin-A1, dek-can fusion protein, DKK1, EFTUD2, Elongation factor 2, ENAH (hMena), Ep-CAM, EpCAM, EphA3, epithelial tumor antigen ("ETA"), ETV6-AML1 fusion protein, EZH2, FGF5, FLT3-ITD, FN1, G250/MN/CAIX, GAGE-1,2,8, GAGE-3,4,5,6,7, GAS7, glypican-3, GnTV, gp100/Pmel17, GPNMB, HAUS3, Hepsin, HER-2/neu, HERV-K-MEL, HLA-A11, HLA-A2, HLA-DOB, hsp70-2, IDO1, IGF2B3, IL13Ralpha2, Intestinal carboxyl esterase, K-ras, Kallikrein 4, KIF20A, KK-LC-1, KKLC1, KM-HN-1, KMHN1 also known as CCDC110, LAGE-1, LDLR-fucosyltransferaseAS fusion protein, Lengsin, M-CSF, MAGE-A1, MAGE-A10, MAGE-A12, MAGE-A2, MAGE-A3, MAGE-A4, MAGE-A6, MAGE-A9, MAGE-C1, MAGE-C2, malic enzyme, mammaglobin-A, MART2, MATN, MC1R, MCSP, mdm-2, ME1, Melan-A/MART-1, Meloe, Midkine, MMP-2, MMP-7, MUC1, MUC5AC, mucin, MUM-1, MUM-2, MUM-3, Myosin, Myosin class I, N-raw, NA88-A, neo-PAP, NFYC, NY-BR-1, NY-ESO-1/LAGE-2, OA1, OGT, OS-9, P polypeptide, p53, PAP, PAX5, PBF, pml-RARalpha fusion protein, polymorphic epithelial mucin ("PEM"), PPP1R3B, PRAME, PRDX5, PSA, PSMA, PTPRK, RAB38/NY-MEL-1, RAGE-1, RBAF600, RGS5, RhoC, RNF43, RU2AS, SAGE, secernin 1, SIRT2, SNRPD1, SOX10, Sp17, SPA17, SSX-2, SSX-4, STEAP1, survivin, SYT-SSX1 or -SSX2 fusion protein, TAG-1, TAG-2, Telomerase, TGF-betaRII, TPBG, TRAG-3, Triosephosphate isomerase, TRP-1/gp75, TRP-2, TRP2-INT2, tyrosinase, tyrosinase ("TYR"), VEGF, WT1, XAGE-1b/GAGED2a. In some embodiments, the antigen is a neoantigen.

In some embodiments, the cancer immunotherapy comprises administration of a cancer-specific chimeric antigen receptor (CAR). In some embodiments, the CAR is administered on the surface of a T cell. In some embodiments, the CAR binds specifically to a cancer-associated antigen.

In some embodiments, the cancer immunotherapy comprises administration of a cancer-specific T cell to the subject. In some embodiments, the T cell is a CD4$^+$ T cell. In some embodiments, the CD4$^+$ T cell is a $T_H1$ T cell, a $T_H2$ T cell or a $T_H17$ T cell. In some embodiments, the T cell expresses a T cell receptor specific for a cancer-associated antigen.

In some embodiments, the cancer vaccine is administered with an adjuvant. Examples of adjuvants include, but are not limited to, an immune modulatory protein, Adjuvant 65, α-GalCer, aluminum phosphate, aluminum hydroxide, calcium phosphate, β-Glucan Peptide, CpG DNA, GPI-0100, lipid A, lipopolysaccharide, Lipovant, Montanide, N-acetyl-muramyl-L-alanyl-D-isoglutamine, Pam3CSK4, quil A and trehalose dimycolate.

In some embodiments, the immunotherapy agent is an immune modulating protein to the subject. In some embodiments, the immune modulatory protein is a cytokine. Examples of immune modulating proteins include, but are not limited to, B lymphocyte chemoattractant ("BLC"), C-C motif chemokine 11 ("Eotaxin-1"), Eosinophil chemotactic protein 2 ("Eotaxin-2"), Granulocyte colony-stimulating factor ("G-CSF"), Granulocyte macrophage colony-stimulating factor ("GM-CSF"), 1-309, Intercellular Adhesion Molecule 1 ("ICAM-1"), Interferon gamma ("IFN-gamma"), Interlukin-1 alpha ("IL-1 alpha"), Interlukin-1 beta ("IL-1 beta"), Interleukin 1 receptor antagonist ("IL-1 ra"), Interleukin-2 ("IL-2"), Interleukin-4 ("IL-4"), Interleukin-5 ("IL-5"), Interleukin-6 ("IL-6"), Interleukin-6 soluble receptor ("IL-6 sR"), Interleukin-7 ("IL-7"), Interleukin-8 ("IL-8"), Interleukin-10 ("IL-10"), Interleukin-11 ("IL-11"), Subunit beta of Interleukin-12 ("IL-12 p40" or "IL-12 p'70"), Interleukin-13 ("IL-13"), Interleukin-15 ("IL-15"), Interleukin-16 ("IL-16"), Interleukin-17 ("IL-17"), Chemokine (C-C motif) Ligand 2 ("MCP-1"), Macrophage colony-stimulating factor ("M-CSF"), Monokine induced by gamma interferon ("MIG"), Chemokine (C-C motif) ligand 2 ("MIP-1 alpha"), Chemokine (C-C motif) ligand 4 ("MIP-1 beta"), Macrophage inflammatory protein-1-delta ("MIP-1 delta"), Platelet-derived growth factor subunit B ("PDGF-BB"), Chemokine (C-C motif) ligand 5, Regulated on Activation, Normal T cell Expressed and Secreted ("RANTES"), TIMP metallopeptidase inhibitor 1 ("TIMP-1"), TIMP metallopeptidase inhibitor 2 ("TIMP-2"), Tumor necrosis factor, lymphotoxin-alpha ("TNF alpha"), Tumor necrosis factor, lymphotoxin-beta ("TNF beta"), Soluble TNF receptor type 1 ("sTNFRI"), sTNFRIIAR, Brain-derived neurotrophic factor ("BDNF"), Basic fibroblast growth factor ("bFGF"), Bone morphogenetic protein 4 ("BMP-4"), Bone morphogenetic protein 5 ("BMP-5"), Bone morphogenetic protein 7 ("BMP-7"), Nerve growth factor ("b-NGF"), Epidermal growth factor ("EGF"), Epidermal growth factor receptor ("EGFR"), Endocrine-gland-derived vascular endothelial growth factor ("EG-VEGF"), Fibroblast growth factor 4 ("FGF-4"), Keratinocyte growth factor ("FGF-7"), Growth differentiation factor 15 ("GDF-15"), Glial cell-derived neurotrophic factor ("GDNF"), Growth Hormone, Heparin-binding EGF-like growth factor ("HB-EGF"), Hepatocyte growth factor ("HGF"), Insulin-like growth factor binding protein 1 ("IGFBP-1"), Insulin-like growth factor binding protein 2 ("IGFBP-2"), Insulin-like growth factor binding protein 3 ("IGFBP-3"), Insulin-like growth factor binding protein 4 ("IGFBP-4"), Insulin-like growth factor binding protein 6 ("IGFBP-6"), Insulin-like growth factor 1 ("IGF-1"), Insulin, Macrophage colony-stimulating factor ("M-CSF R"), Nerve growth factor receptor ("NGF R"), Neurotrophin-3 ("NT-3"), Neurotrophin-4 ("NT-4"), Osteoclastogenesis inhibitory factor ("Osteoprotegerin"), Platelet-derived growth factor receptors ("PDGF-AA"), Phosphatidylinositol-glycan biosynthesis ("PIGF"), Skp, Cullin, F-box containing complex ("SCF"), Stem cell factor receptor ("SCF R"), Transforming growth factor alpha ("TGFalpha"), Transforming growth factor beta-1 ("TGF beta 1"), Transforming growth factor beta-3 ("TGF beta 3"), Vascular endothelial growth factor ("VEGF"), Vascular endothelial growth factor receptor 2 ("VEGFR2"), Vascular endothelial growth factor receptor 3 ("VEGFR3"), VEGF-D 6Ckine, Tyrosine-protein kinase receptor UFO ("Axl"), Betacellulin ("BTC"), Mucosae-associated epithelial chemokine ("CCL28"), Chemokine (C-C motif) ligand 27 ("CTACK"), Chemokine (C-X-C motif) ligand 16 ("CXCL16"), C-X-C motif chemokine 5 ("ENA-78"), Chemokine (C-C motif) ligand 26 ("Eotaxin-3"), Granulocyte chemotactic protein 2 ("GCP-2"), GRO, Chemokine (C-C motif) ligand 14 ("HCC-1"), Chemokine (C-C motif) ligand 16 ("HCC-4"), Interleukin-9 ("IL-9"), Interleukin-17 F ("IL-17F"), Interleukin-18-binding protein ("IL-18 BPa"), Interleukin-28 A ("IL-28A"), Interleukin 29 ("IL-29"), Interleukin 31 ("IL-31"), C-X—C motif chemokine 10 ("IP-10"), Chemokine receptor CXCR3 ("I-TAC"), Leukemia inhibitory factor ("LIF"), Light, Chemokine (C motif) ligand ("Lymphotactin"), Monocyte chemoattractant protein 2 ("MCP-2"), Monocyte chemoattractant protein 3 ("MCP-3"), Monocyte chemoattractant protein 4 ("MCP-4"), Macrophage-derived chemokine ("MDC"), Macrophage migration inhibitory factor ("MIF"), Chemokine (C-C motif) ligand 20 ("MIP-3 alpha"), C-C motif chemokine 19 ("MIP-3 beta"), Chemokine (C-C motif) ligand 23 ("MPIF-1"), Macrophage stimulating protein alpha chain ("MSPalpha"), Nucleosome assembly protein 1-like 4 ("NAP-2"), Secreted phosphoprotein 1 ("Osteopontin"), Pulmonary and activation-regulated cytokine ("PARC"), Platelet factor 4 ("PF4"), Stroma cell-derived factor-1 alpha ("SDF-1 alpha"), Chemokine (C-C motif) ligand 17 ("TARC"), Thymus-expressed chemokine ("TECK"), Thymic stromal lymphopoietin ("TSLP 4-IBB"), CD 166 antigen ("ALCAM"), Cluster of Differentiation 80 ("B7-1"), Tumor necrosis factor receptor superfamily member 17 ("BCMA"), Cluster of Differentiation 14 ("CD14"), Cluster of Differentiation 30 ("CD30"), Cluster of Differentiation 40 ("CD40 Ligand"), Carcinoembryonic antigen-related cell adhesion molecule 1 (biliary glycoprotein) ("CEACAM-1"), Death Receptor 6 ("DR6"), Deoxythymidine kinase ("Dtk"), Type 1 membrane glycoprotein ("Endoglin"), Receptor tyrosine-protein kinase erbB-3 ("ErbB3"), Endothelial-leukocyte adhesion molecule 1 ("E-Selectin"), Apoptosis antigen 1 ("Fas"), Fms-like tyrosine kinase 3 ("Flt-3L"), Tumor necrosis factor receptor superfamily member 1 ("GITR"), Tumor necrosis factor receptor superfamily member 14 ("HVEM"), Intercellular adhesion molecule 3 ("ICAM-3"), IL-1 R4, IL-1 RI, IL-10 Rbeta, IL-17R, IL-2Rgamma, IL-21R, Lysosome membrane protein 2 ("LIMPII"), Neutrophil gelatinase-associated lipocalin ("Lipocalin-2"), CD62L ("L-Selectin"), Lymphatic endothelium ("LYVE-1"), MHC class I polypeptide-related sequence A ("MICA"), MHC class I polypeptide-related sequence B ("MICB"), NRGl-betal, Beta-type platelet-derived growth factor receptor ("PDGF Rbeta"), Platelet endothelial cell adhesion molecule ("PECAM-1"), RAGE, Hepatitis A virus cellular receptor 1 ("TIM-1"), Tumor necrosis factor receptor superfamily member IOC ("TRAIL R3"), Trappin protein transglutaminase binding domain ("Trappin-2"), Urokinase receptor ("uPAR"), Vascular cell adhesion protein 1 ("VCAM-1"), XEDARActivin A, Agouti-related protein ("AgRP"), Ribonuclease 5 ("Angiogenin"), Angiopoietin 1, Angiostatin, Catheprin S, CD40, Cryptic family protein D3 ("Cripto-1"), DAN, Dickkopf-related protein 1 ("DKK-1"), E-Cadherin, Epithelial cell adhesion molecule ("EpCAM"), Fas Ligand (FasL or CD95L), Fcg RIIB/C, FoUistatin, Galectin-7, Intercellular adhesion molecule 2 ("ICAM-2"), IL-13 R1, IL-13R2, IL-17B, IL-2 Ra, IL-2 Rb, IL-23, LAP, Neuronal cell adhesion molecule ("NrCAM"), Plasminogen activator inhibitor-1 ("PAI-1"), Platelet derived growth factor receptors ("PDGF-AB"), Resistin, stromal cell-derived factor 1 ("SDF-1 beta"), sgpl30, Secreted frizzled-related protein 2 ("ShhN"), Sialic acid-binding immunoglobulin-type lectins ("Siglec-5"), ST2, Transforming growth factor-beta 2 ("TGF beta 2"), Tie-2, Thrombopoietin ("TPO"), Tumor necrosis factor receptor superfamily member 10D ("TRAIL R4"), Triggering receptor expressed on myeloid cells 1 ("TREM-1"), Vascular endothelial growth factor C ("VEGF-C"), VEGFR1Adiponectin, Adipsin ("AND"), Alpha-fetoprotein ("AFP"), Angiopoietin-like 4 ("ANGPTL4"), Beta-2-microglobulin ("B2M"), Basal cell adhesion molecule ("BCAM"), Carbohydrate antigen 125 ("CA125"), Cancer Antigen 15-3 ("CA15-3"), Carcinoembryonic antigen ("CEA"), cAMP receptor protein ("CRP"), Human Epidermal Growth Factor Receptor 2 ("ErbB2"), Follistatin, Follicle-stimulating hormone ("FSH"), Chemokine (C-X-C motif) ligand 1 ("GRO alpha"), human chorionic gonadotropin ("beta HCG"), Insulin-like growth factor 1 receptor ("IGF-1 sR"), IL-1 sRII, IL-3, IL-18 Rb, IL-21, Leptin, Matrix metalloproteinase-1 ("MMP-1"), Matrix metalloproteinase-2 ("MMP-2"), Matrix metalloproteinase-3 ("MMP-3"), Matrix metalloproteinase-8 ("MMP-8"), Matrix metalloproteinase-9 ("MMP-9"), Matrix metalloproteinase-10 ("MMP-10"), Matrix metalloproteinase-13 ("MMP-13"), Neural Cell Adhesion Molecule ("NCAM-1"), Entactin ("Nidogen-1"), Neuron specific enolase ("NSE"), Oncostatin M ("OSM"), Procalcitonin, Prolactin, Prostate specific antigen ("PSA"), Sialic acid-binding Ig-like lectin 9 ("Siglec-9"), ADAM 17 endopeptidase ("TACE"), Thyroglobulin, Metalloproteinase inhibitor 4 ("TIMP-4"), TSH2B4, Disintegrin and metalloproteinase domain-containing protein 9 ("ADAM-9"), Angiopoietin 2, Tumor necrosis factor ligand superfamily member 13/Acidic leucine-rich nuclear phosphoprotein 32 family member B ("APRIL"), Bone morphogenetic protein 2 ("BMP-2"), Bone morphogenetic protein 9 ("BMP-9"), Complement component 5a ("C5a"), Cathepsin L, CD200, CD97, Chemerin, Tumor necrosis factor receptor superfamily member 6B ("DcR3"), Fatty acid-binding protein 2 ("FABP2"), Fibroblast activation protein, alpha ("FAP"), Fibroblast growth factor 19 ("FGF-19"), Galectin-3, Hepatocyte growth factor receptor ("HGF R"), IFN-gammalpha/beta R2, Insulin-like growth factor 2 ("IGF-2"), Insulin-like growth factor 2 receptor ("IGF-2 R"), Interleukin-1 receptor 6 ("IL-1R6"), Interleukin 24 ("IL-24"), Interleukin 33 ("IL-33", Kallikrein 14, Asparaginyl endopeptidase ("Legumain"), Oxidized low-density lipoprotein receptor 1 ("LOX-1"), Mannose-binding lectin ("MBL"), Neprilysin ("NEP"), Notch homolog 1, translocation-associated (Drosophila) ("Notch-1"), Nephroblastoma overexpressed ("NOV"), Osteoactivin, Programmed cell death protein 1 ("PD-1"), N-acetylmuramoyl-L-alanine amidase ("PGRP-5"), Serpin A4, Secreted frizzled related protein 3 ("sFRP-3"), Thrombomodulin, Tolllike receptor 2 ("TLR2"), Tumor necrosis factor receptor superfamily member 10A ("TRAIL R1"), Transferrin ("TRF"), WIF-1ACE-2, Albumin, AMICA, Angiopoietin 4, B-cell activating factor ("BAFF"), Carbohydrate antigen 19-9 ("CA19-9"), CD 163, Clusterin, CRT AM, Chemokine (C-X-C motif) ligand 14 ("CXCL14"), Cystatin C, Decorin ("DCN"), Dickkopf-related protein 3 ("Dkk-3"), Delta-like protein 1 ("DLL1"), Fetuin A, Heparin-binding growth factor 1 ("aFGF"), Folate receptor alpha ("FOLR1"), Furin, GPCR-associated sorting protein 1 ("GASP-1"), GPCR-associated sorting protein 2 ("GASP-2"), Granulocyte colony-stimulating factor receptor ("GCSF R"), Serine protease hepsin ("HAI-2"), Interleukin-17B Receptor ("IL-17B R"), Interleukin 27 ("IL-27"), Lymphocyte-activation gene 3 ("LAG-3"), Apolipoprotein A-V ("LDL R"), Pepsinogen I, Retinol binding protein 4 ("RBP4"), SOST, Heparan sulfate proteoglycan ("Syndecan-1"), Tumor necrosis factor receptor superfamily member 13B ("TACI"), Tissue factor pathway inhibitor ("TFPI"), TSP-1, Tumor necrosis factor receptor superfamily, member 10b ("TRAIL R2"), TRANCE, Troponin I, Urokinase Plasminogen Activator ("uPA"), Cadherin 5, type 2 or VE-cadherin (vascular endothelial) also known as CD144 ("VE-Cadherin"), WNT1-inducible-signaling pathway protein 1 ("WISP-1"), and Receptor Activator of Nuclear Factor κ B ("RANK").

In some embodiments, the cancer therapeutic is a radioactive moiety that comprises a radionuclide. Exemplary radionuclides include, but are not limited to Cr-51, Cs-131, Ce-134, Se-75, Ru-97, Eu-149, Os-189m, Sb-119, I-123, Ho-161, Sb-117, Ce-139, In-111, Rh-103m, Ga-67, Tl-201, Pd-103, Au-195, Hg-197, Sr-87m, Pt-191, P-33, Er-169, Ru-103, Yb-169, Au-199, Sn-121, Tm-167, Yb-175, In-113m, Sn-113, Lu-177, Rh-105, Sn-117m, Cu-67, Sc-47, Pt-195m, Ce-141, I-131, Tb-161, As-77, Pt-197, Sm-153, Gd-159, Tm-173, Pr-143, Au-198, Tm-170, Re-186, Ag-111, Pd-109, Ga-73, Dy-165, Pm-149, Sn-123, Sr-89, Ho-166, P-32, Re-188, Pr-142, Ir-194, In-114m/In-114, and Y-90.

In some embodiments, the cancer therapeutic is an angiogenesis inhibitor to the subject. Examples of such angiogenesis inhibitors include, but are not limited to Bevacizumab (Avastin®), Ziv-aflibercept (Zaltrap®), Sorafenib (Nexavar®), Sunitinib (Sutent®), Pazopanib (Votrient®), Regorafenib (Stivarga®), and Cabozantinib (Cometrig™).

In some embodiments, the cancer therapeutic is an antibiotic. For example, if the presence of a cancer-associated bacteria and/or a cancer-associated microbiome profile is detected according to the methods provided herein, antibiotics can be administered to eliminate the cancer-associated bacteria from the subject. "Antibiotics" broadly refers to compounds capable of inhibiting or preventing a bacterial infection. Antibiotics can be classified in a number of ways, including their use for specific infections, their mechanism of action, their bioavailability, or their spectrum of target microbe (e.g., Gram-negative vs. Gram-positive bacteria, aerobic vs. anaerobic bacteria, etc.) and these may be used to kill specific bacteria in specific areas of the host ("niches") (Leekha, et al 2011. General Principles of Antimicrobial Therapy. Mayo Clin Proc. 86(2): 156-167). In certain embodiments, antibiotics can be used to selectively target bacteria of a specific niche. In some embodiments, antibiotics known to treat a particular infection that includes a cancer niche may be used to target cancer-associated microbes, including cancer-associated bacteria in that niche. In other embodiments, antibiotics are administered after the bacterial treatment. In some embodiments, antibiotics are administered after the bacterial treatment to remove the engraftment.

In some aspects, antibiotics can be selected based on their bactericidal or bacteriostatic properties. Bactericidal antibiotics include mechanisms of action that disrupt the cell wall (e.g., (β-lactams), the cell membrane (e.g., daptomycin), or bacterial DNA (e.g., fluoroquinolones). Bacteriostatic agents inhibit bacterial replication and include sulfonamides, tetracyclines, and macrolides, and act by inhibiting protein synthesis. Furthermore, while some drugs can be bactericidal in certain organisms and bacteriostatic in others, knowing the target organism allows one skilled in the art to select an antibiotic with the appropriate properties. In certain treatment conditions, bacteriostatic antibiotics inhibit the activity of bactericidal antibiotics. Thus, in certain embodiments, bactericidal and bacteriostatic antibiotics are not combined.

Antibiotics include, but are not limited to aminoglycosides, ansamycins, carbacephems, carbapenems, cephalosporins, glycopeptides, lincosamides, lipopeptides, macrolides, monobactams, nitrofurans, oxazolidonones, penicillins, polypeptide antibiotics, quinolones, fluoroquinolone, sulfonamides, tetracyclines, and anti-mycobacterial compounds, and combinations thereof.

Aminoglycosides include, but are not limited to Amikacin, Gentamicin, Kanamycin, Neomycin, Netilmicin, Tobramycin, Paromomycin, and Spectinomycin. Aminoglycosides are effective, e.g., against Gram-negative bacteria, such as *Escherichia coli, Klebsiella, Pseudomonas aeruginosa*, and *Francisella tularensis*, and against certain aerobic bacteria but less effective against obligate/facultative anaerobes. Aminoglycosides are believed to bind to the bacterial 30S or 50S ribosomal subunit thereby inhibiting bacterial protein synthesis.

Ansamycins include, but are not limited to, Geldanamycin, Herbimycin, Rifamycin, and Streptovaricin. Geldanamycin and Herbimycin are believed to inhibit or alter the function of Heat Shock Protein 90.

Carbacephems include, but are not limited to, Loracarbef. Carbacephems are believed to inhibit bacterial cell wall synthesis.

Carbapenems include, but are not limited to, Ertapenem, Doripenem, Imipenem/Cilastatin, and Meropenem. Carbapenems are bactericidal for both Gram-positive and Gram-negative bacteria as broad-spectrum antibiotics. Carbapenems are believed to inhibit bacterial cell wall synthesis.

Cephalosporins include, but are not limited to, Cefadroxil, Cefazolin, Cefalotin, Cefalothin, Cefalexin, Cefaclor, Cefamandole, Cefoxitin, Cefprozil, Cefuroxime, Cefixime, Cefdinir, Cefditoren, Cefoperazone, Cefotaxime, Cefpodoxime, Ceftazidime, Ceftibuten, Ceftizoxime, Ceftriaxone, Cefepime, Ceftaroline fosamil, and Ceftobiprole. Selected Cephalosporins are effective, e.g., against Gram-negative bacteria and against Gram-positive bacteria, including *Pseudomonas*, certain Cephalosporins are effective against methicillin-resistant *Staphylococcus aureus* (MRSA). Cephalosporins are believed to inhibit bacterial cell wall synthesis by disrupting synthesis of the peptidoglycan layer of bacterial cell walls.

Glycopeptides include, but are not limited to, Teicoplanin, Vancomycin, and Telavancin. Glycopeptides are effective, e.g., against aerobic and anaerobic Gram-positive bacteria including MRSA and *Clostridium difficile*. Glycopeptides are believed to inhibit bacterial cell wall synthesis by disrupting synthesis of the peptidoglycan layer of bacterial cell walls.

Lincosamides include, but are not limited to, Clindamycin and Lincomycin. Lincosamides are effective, e.g., against anaerobic bacteria, as well as *Staphylococcus*, and *Streptococcus*. Lincosamides are believed to bind to the bacterial 50S ribosomal subunit thereby inhibiting bacterial protein synthesis.

Lipopeptides include, but are not limited to, Daptomycin. Lipopeptides are effective, e.g., against Gram-positive bacteria. Lipopeptides are believed to bind to the bacterial membrane and cause rapid depolarization.

Macrolides include, but are not limited to, Azithromycin, Clarithromycin, Dirithromycin, Erythromycin, Roxithromycin, Troleandomycin, Telithromycin, and Spiramycin. Macrolides are effective, e.g., against *Streptococcus* and *Mycoplasma*. Macrolides are believed to bind to the bacterial or 50S ribosomal subunit, thereby inhibiting bacterial protein synthesis.

Monobactams include, but are not limited to, Aztreonam. Monobactams are effective, e.g., against Gram-negative bacteria. Monobactams are believed to inhibit bacterial cell wall synthesis by disrupting synthesis of the peptidoglycan layer of bacterial cell walls.

Nitrofurans include, but are not limited to, Furazolidone and Nitrofurantoin.

Oxazolidonones include, but are not limited to, Linezolid, Posizolid, Radezolid, and Torezolid. Oxazolidonones are believed to be protein synthesis inhibitors.

Penicillins include, but are not limited to, Amoxicillin, Ampicillin, Azlocillin, Carbenicillin, Cloxacillin, Dicloxacillin, Flucloxacillin, Mezlocillin, Methicillin, Nafcillin, Oxacillin, Penicillin G, Penicillin V, Piperacillin, Temocillin and Ticarcillin. Penicillins are effective, e.g., against Gram-positive bacteria, facultative anaerobes, e.g., *Streptococcus*, *Borrelia*, and *Treponema*. Penicillins are believed to inhibit bacterial cell wall synthesis by disrupting synthesis of the peptidoglycan layer of bacterial cell walls.

Penicillin combinations include, but are not limited to, Amoxicillin/clavulanate, Ampicillin/sulbactam, Piperacillin/tazobactam, and Ticarcillin/clavulanate.

Polypeptide antibiotics include, but are not limited to, Bacitracin, Colistin, and Polymyxin B and E. Polypeptide Antibiotics are effective, e.g., against Gram-negative bacteria. Certain polypeptide antibiotics are believed to inhibit isoprenyl pyrophosphate involved in synthesis of the peptidoglycan layer of bacterial cell walls, while others destabilize the bacterial outer membrane by displacing bacterial counter-ions.

Quinolones and Fluoroquinolone include, but are not limited to, Ciprofloxacin, Enoxacin, Gatifloxacin, Gemifloxacin, Levofloxacin, Lomefloxacin, Moxifloxacin, Nalidixic acid, Norfloxacin, Ofloxacin, Trovafloxacin, Grepafloxacin, Sparfloxacin, and Temafloxacin. Quinolones/Fluoroquinolone are effective, e.g., against *Streptococcus* and *Neisseria*. Quinolones/Fluoroquinolone are believed to inhibit the bacterial DNA gyrase or topoisomerase IV, thereby inhibiting DNA replication and transcription.

Sulfonamides include, but are not limited to, Mafenide, Sulfacetamide, Sulfadiazine, Silver sulfadiazine, Sulfadimethoxine, Sulfamethizole, Sulfamethoxazole, Sulfanilimide, Sulfasalazine, Sulfisoxazole, Trimethoprim-Sulfamethoxazole (Co-trimoxazole), and Sulfonamidochrysoidine. Sulfonamides are believed to inhibit folate synthesis by competitive inhibition of dihydropteroate synthetase, thereby inhibiting nucleic acid synthesis.

Tetracyclines include, but are not limited to, Demeclocycline, Doxycycline, Minocycline, Oxytetracycline, and Tetracycline. Tetracyclines are effective, e.g., against Gram-negative bacteria. Tetracyclines are believed to bind to the bacterial 30S ribosomal subunit thereby inhibiting bacterial protein synthesis.

Anti-mycobacterial compounds include, but are not limited to, Clofazimine, Dapsone, Capreomycin, Cycloserine, Ethambutol, Ethionamide, Isoniazid, Pyrazinamide, Rifampicin, Rifabutin, Rifapentine, and Streptomycin.

Suitable antibiotics also include arsphenamine, chloramphenicol, fosfomycin, fusidic acid, metronidazole, mupirocin, platensimycin, quinupristin/dalfopristin, tigecycline, tinidazole, trimethoprim amoxicillin/clavulanate, ampicillin/sulbactam, amphomycin ristocetin, azithromycin, bacitracin, buforin II, carbomycin, cecropin Pl, clarithromycin, erythromycins, furazolidone, fusidic acid, Na fusidate, gramicidin, imipenem, indolicidin, josamycin, magainan II, metronidazole, nitroimidazoles, mikamycin, mutacin B-Ny266, mutacin B-JHl 140, mutacin J-T8, nisin, nisin A, novobiocin, oleandomycin, ostreogrycin, piperacillin/tazobactam, pristinamycin, ramoplanin, ranalexin, reuterin, rifaximin, rosamicin, rosaramicin, spectinomycin, spiramycin, staphylomycin, streptogramin, streptogramin A, synergistin, taurolidine, teicoplanin, telithromycin, ticarcillin/clavulanic acid, triacetyloleandomycin, tylosin, tyrocidin, tyrothricin, vancomycin, vemamycin, and virginiamycin.

In some embodiments, the cancer therapy comprises administering a therapeutic bacteria and/or a therapeutic combination of bacteria to the subject so a healthy microbiome can be reconstituted in the subject. In some embodiments, the therapeutic bacteria is a non-cancer-associated bacteria. In some embodiments the therapeutic bacteria is a probiotic bacteria.

Cancer

In some embodiments, the methods and compositions described herein relate to the treatment of cancer. Examples of cancers that may treated by methods described herein include, but are not limited to, hematological malignancy, acute nonlymphocytic leukemia, chronic lymphocytic leukemia, acute granulocytic leukemia, chronic granulocytic leukemia, acute promyelocytic leukemia, adult T-cell leukemia, aleukemic leukemia, a leukocythemic leukemia, basophilic leukemia, blast cell leukemia, bovine leukemia, chronic myelocytic leukemia, leukemia cutis, embryonal leukemia, eosinophilic leukemia, Gross' leukemia, Rieder cell leukemia, Schilling's leukemia, stem cell leukemia, subleukemic leukemia, undifferentiated cell leukemia, hairy-cell leukemia, hemoblastic leukemia, hemocytoblastic leukemia, histiocytic leukemia, stem cell leukemia, acute monocytic leukemia, leukopenic leukemia, lymphatic leukemia, lymphoblastic leukemia, lymphocytic leukemia, lymphogenous leukemia, lymphoid leukemia, lymphosarcoma cell leukemia, mast cell leukemia, megakaryocytic leukemia, micromyeloblastic leukemia, monocytic leukemia, myeloblastic leukemia, myelocytic leukemia, myeloid granulocytic leukemia, myelomonocytic leukemia, Naegeli leukemia, plasma cell leukemia, plasmacytic leukemia, promyelocytic leukemia, acinar carcinoma, acinous carcinoma, adenocystic carcinoma, adenoid cystic carcinoma, carcinoma adenomatosum, carcinoma of adrenal cortex, alveolar carcinoma, alveolar cell carcinoma, basal cell carcinoma, carcinoma basocellulare, basaloid carcinoma, basosquamous cell carcinoma, bronchioalveolar carcinoma, bronchiolar carcinoma, bronchogenic carcinoma, cerebriform carcinoma, cholangiocellular carcinoma, chorionic carcinoma, colloid carcinoma, comedo carcinoma, corpus carcinoma, cribriform carcinoma, carcinoma en cuirasse, carcinoma cutaneum, cylindrical carcinoma, cylindrical cell carcinoma, duct carcinoma, carcinoma durum, embryonal carcinoma, encephaloid carcinoma, epiennoid carcinoma, carcinoma epitheliale adenoides, exophytic carcinoma, carcinoma ex ulcere, carcinoma fibrosum, gelatiniform carcinoma, gelatinous carcinoma, giant cell carcinoma, signet-ring cell carcinoma, carcinoma simplex, small-cell carcinoma, solanoid carcinoma, spheroidal cell carcinoma, spindle cell carcinoma, carcinoma spongiosum, squamous carcinoma, squamous cell carcinoma, string carcinoma, carcinoma telangiectaticum, carcinoma telangiectodes, transitional cell carcinoma, carcinoma tuberosum, tuberous carcinoma, verrucous carcinoma, carcinoma villosum, carcinoma gigantocellulare, glandular carcinoma, granulosa cell carcinoma, hair-matrix carcinoma, hematoid carcinoma, hepatocellular carcinoma, Hurthle cell carcinoma, hyaline carcinoma, hypernephroid carcinoma, infantile embryonal carcinoma, carcinoma in situ, intraepidermal carcinoma, intraepithelial carcinoma, Krompecher's carcinoma, Kulchitzky-cell carcinoma, large-cell carcinoma, lenticular carcinoma, carcinoma lenticulare, lipomatous carcinoma, lymphoepithelial carcinoma, carcinoma medullare, medullary carcinoma, melanotic carcinoma, carcinoma molle, mucinous carcinoma, carcinoma muciparum, carcinoma mucocellulare, mucoepidermoid carcinoma, carcinoma mucosum, mucous carcinoma, carcinoma myxomatodes, naspharyngeal carcinoma, oat cell carcinoma, carcinoma ossificans, osteoid carcinoma, papillary carcinoma, periportal carcinoma, preinvasive carcinoma, prickle cell carcinoma, pultaceous carcinoma, renal cell carcinoma of kidney, reserve cell carcinoma, carcinoma sarcomatodes, schneiderian carcinoma, scirrhous carcinoma, carcinoma scroti, chondrosarcoma, fibrosarcoma, lymphosarcoma, melanosarcoma, myxosarcoma, osteosarcoma, endometrial sarcoma, stromal sarcoma, Ewing's sarcoma, fascial sarcoma, fibroblastic sarcoma, giant cell sarcoma, Abemethy's sarcoma, adipose sarcoma, liposarcoma, alveolar soft part sarcoma, ameloblastic sarcoma, botryoid sarcoma, chloroma sarcoma, chorio carcinoma, embryonal sarcoma, Wilms' tumor sarcoma, granulocytic sarcoma, Hodgkin's sarcoma, idiopathic multiple pigmented hemorrhagic sarcoma, immunoblastic sarcoma of B cells, lymphoma, immunoblastic sarcoma of T-cells, Jensen's sarcoma, Kaposi's sarcoma, Kupffer cell sarcoma, angiosarcoma, leukosarcoma, malignant mesenchymoma sarcoma, parosteal sarcoma, reticulocytic sarcoma, rhabdosarcoma, serocystic sarcoma, synovial sarcoma, telangiectaltic sarcoma, Hodgkin's Disease, Non-Hodgkin's Lymphoma, multiple myeloma, neuroblastoma, bladder cancer, breast cancer, ovarian cancer, lung cancer, colorectal cancer, rhabdomyosarcoma, primary thrombocytosis, primary macroglobulinemia, small-cell lung tumors, primary brain tumors, stomach cancer, colon cancer, malignant pancreatic insulanoma, malignant carcinoid, premalignant skin lesions, testicular cancer, lymphomas, thyroid cancer, neuroblastoma, esophageal cancer, genitourinary tract cancer, malignant hypercalcemia, cervical cancer, endometrial cancer, adrenal cortical cancer, Harding-Passey melanoma, juvenile melanoma, lentigo maligna melanoma, malignant melanoma, acral-lentiginous melanoma, amelanotic melanoma, benign juvenile melanoma, Cloudman's melanoma, S91 melanoma, nodular melanoma subungal melanoma, and superficial spreading melanoma.

In some embodiments, the methods and compositions provided herein relate to the treatment of a leukemia. The term "leukemia" is meant broadly progressive, malignant diseases of the hematopoietic organs/systems and is generally characterized by a distorted proliferation and development of leukocytes and their precursors in the blood and bone marrow. Non-limiting examples of leukemia diseases include, acute nonlymphocytic leukemia, chronic lymphocytic leukemia, acute granulocytic leukemia, chronic granulocytic leukemia, acute promyelocytic leukemia, adult T-cell leukemia, aleukemic leukemia, a leukocythemic leukemia, basophilic leukemia, blast cell leukemia, bovine leukemia, chronic myelocytic leukemia, leukemia cutis, embryonal leukemia, eosinophilic leukemia, Gross' leukemia, Rieder cell leukemia, Schilling's leukemia, stem cell leukemia, subleukemic leukemia, undifferentiated cell leukemia, hairy-cell leukemia, hemoblastic leukemia, hemocytoblastic leukemia, histiocytic leukemia, stem cell leukemia, acute monocytic leukemia, leukopenic leukemia, lymphatic leukemia, lymphoblastic leukemia, lymphocytic leukemia, lymphogenous leukemia, lymphoid leukemia, lymphosarcoma cell leukemia, mast cell leukemia, megakaryocytic leukemia, micromyeloblastic leukemia, monocytic leukemia, myeloblastic leukemia, myelocytic leukemia, myeloid granulocytic leukemia, myelomonocytic leukemia, Naegeli leukemia, plasma cell leukemia, plasmacytic leukemia, and promyelocytic leukemia.

In some embodiments, the methods and compositions provided herein relate to the treatment of a carcinoma. The term "carcinoma" refers to a malignant growth made up of epithelial cells tending to infiltrate the surrounding tissues, and/or resist physiological and non-physiological cell death signals and gives rise to metastases. Non-limiting exemplary types of carcinomas include, acinar carcinoma, acinous carcinoma, adenocystic carcinoma, adenoid cystic carcinoma, carcinoma adenomatosum, carcinoma of adrenal cortex, alveolar carcinoma, alveolar cell carcinoma, basal cell carcinoma, carcinoma basocellulare, basaloid carcinoma, basosquamous cell carcinoma, bronchioalveolar carcinoma, bronchiolar carcinoma, bronchogenic carcinoma, cerebriform carcinoma, cholangiocellular carcinoma, chorionic carcinoma, colloid carcinoma, comedo carcinoma, corpus carcinoma, cribriform carcinoma, carcinoma en cuirasse, carcinoma cutaneum, cylindrical carcinoma, cylindrical cell carcinoma, duct carcinoma, carcinoma durum, embryonal carcinoma, encephaloid carcinoma, epiennoid carcinoma, carcinoma epitheliale adenoides, exophytic carcinoma, carcinoma ex ulcere, carcinoma fibrosum, gelatiniform carcinoma, gelatinous carcinoma, giant cell carcinoma, signet-ring cell carcinoma, carcinoma simplex, small-cell carcinoma, solanoid carcinoma, spheroidal cell carcinoma, spindle cell carcinoma, carcinoma spongiosum, squamous carcinoma, squamous cell carcinoma, string carcinoma, carcinoma telangiectaticum, carcinoma telangiectodes, transitional cell carcinoma, carcinoma tuberosum, tuberous carcinoma, verrucous carcinoma, carcinoma villosum, carcinoma gigantocellulare, glandular carcinoma, granulosa cell carcinoma, hair-matrix carcinoma, hematoid carcinoma, hepatocellular carcinoma, Hurthle cell carcinoma, hyaline carcinoma, hypernephroid carcinoma, infantile embryonal carcinoma, carcinoma in situ, intraepidermal carcinoma, intraepithelial carcinoma, Krompecher's carcinoma, Kulchitzky-cell carcinoma, large-cell carcinoma, lenticular carcinoma, carcinoma lenticulare, lipomatous carcinoma, lymphoepithelial carcinoma, carcinoma medullare, medullary carcinoma, melanotic carcinoma, carcinoma molle, mucinous carcinoma, carcinoma muciparum, carcinoma mucocellulare, mucoepidermoid carcinoma, carcinoma mucosum, mucous carcinoma, carcinoma myxomatodes, naspharyngeal carcinoma, oat cell carcinoma, carcinoma ossificans, osteoid carcinoma, papillary carcinoma, periportal carcinoma, preinvasive carcinoma, prickle cell carcinoma, pultaceous carcinoma, renal cell carcinoma of kidney, reserve cell carcinoma, carcinoma sarcomatodes, schneiderian carcinoma, scirrhous carcinoma, and carcinoma scroti.

In some embodiments, the methods and compositions provided herein relate to the treatment of a sarcoma. The term "sarcoma" generally refers to a tumor which is made up of a substance like the embryonic connective tissue and is generally composed of closely packed cells embedded in a fibrillar, heterogeneous, or homogeneous substance. Sarcomas include, but are not limited to, chondrosarcoma, fibrosarcoma, lymphosarcoma, melanosarcoma, myxosarcoma, osteosarcoma, endometrial sarcoma, stromal sarcoma, Ewing's sarcoma, fascial sarcoma, fibroblastic sarcoma, giant cell sarcoma, Abemethy's sarcoma, adipose sarcoma, liposarcoma, alveolar soft part sarcoma, ameloblastic sarcoma, botryoid sarcoma, chloroma sarcoma, chorio carcinoma, embryonal sarcoma, Wilms' tumor sarcoma, granulocytic sarcoma, Hodgkin's sarcoma, idiopathic multiple pigmented hemorrhagic sarcoma, immunoblastic sarcoma of B cells, lymphoma, immunoblastic sarcoma of T-cells, Jensen's sarcoma, Kaposi's sarcoma, Kupffer cell sarcoma, angiosarcoma, leukosarcoma, malignant mesenchymoma sarcoma, parosteal sarcoma, reticulocytic sarcoma, Rous sarcoma, serocystic sarcoma, synovial sarcoma, and telangiectaltic sarcoma.

Additional exemplary neoplasias that can be treated using the methods and compositions described herein include Hodgkin's Disease, Non-Hodgkin's Lymphoma, multiple myeloma, neuroblastoma, breast cancer, ovarian cancer, lung cancer, rhabdomyosarcoma, primary thrombocytosis, primary macroglobulinemia, small-cell lung tumors, primary brain tumors, stomach cancer, colon cancer, malignant pancreatic insulanoma, malignant carcinoid, premalignant skin lesions, testicular cancer, lymphomas, thyroid cancer, neuroblastoma, esophageal cancer, genitourinary tract cancer, malignant hypercalcemia, cervical cancer, endometrial cancer, and adrenal cortical cancer.

In some embodiments, the cancer treated is a melanoma. The term "melanoma" is taken to mean a tumor arising from the melanocytic system of the skin and other organs. Non-limiting examples of melanomas are Harding-Passey melanoma, juvenile melanoma, lentigo maligna melanoma, malignant melanoma, acral-lentiginous melanoma, amelanotic melanoma, benign juvenile melanoma, Cloudman's melanoma, S91 melanoma, nodular melanoma subungal melanoma, and superficial spreading melanoma.

Particular categories of tumors that can be treated using methods and compositions described herein include lymphoproliferative disorders, breast cancer, ovarian cancer, prostate cancer, cervical cancer, endometrial cancer, bone cancer, liver cancer, stomach cancer, colon cancer, colorectal cancer, pancreatic cancer, cancer of the thyroid, head and neck cancer, cancer of the central nervous system, cancer of the peripheral nervous system, skin cancer, kidney cancer, as well as metastases of all the above. Particular types of tumors include hepatocellular carcinoma, hepatoma, hepatoblastoma, rhabdomyosarcoma, esophageal carcinoma, thyroid carcinoma, ganglioblastoma, fibrosarcoma, myxosarcoma, liposarcoma, chondrosarcoma, osteogenic sarcoma, chordoma, angiosarcoma, endotheliosarcoma, Ewing's tumor, leimyosarcoma, rhabdotheliosarcoma, invasive ductal carcinoma, papillary adenocarcinoma, melanoma, pulmonary squamous cell carcinoma, basal cell carcinoma, adenocarcinoma (well differentiated, moderately differentiated, poorly differentiated or undifferentiated), bronchioloalveolar carcinoma, renal cell carcinoma, hypernephroma, hypernephroid adenocarcinoma, bile duct carcinoma, choriocarcinoma, seminoma, embryonal carcinoma, Wilms' tumor, testicular tumor, lung carcinoma including small cell, non-small and large cell lung carcinoma, bladder carcinoma, glioma, astrocyoma, medulloblastoma, craniopharyngioma, ependymoma, pinealoma, retinoblastoma, neuroblastoma, colon carcinoma, rectal carcinoma, hematopoietic malignancies including all types of leukemia and lymphoma including: acute myelogenous leukemia, acute myelocytic leukemia, acute lymphocytic leukemia, chronic myelogenous leukemia, chronic lymphocytic leukemia, mast cell leukemia, multiple myeloma, myeloid lymphoma, Hodgkin's lymphoma, non-Hodgkin's lymphoma.

Cancers treated in certain embodiments also include precancerous lesions, e.g., actinic keratosis (solar keratosis), moles (dysplastic nevi), acitinic chelitis (farmer's lip), cutaneous horns, Barrett's esophagus, atrophic gastritis, dyskeratosis congenita, sideropenic dysphagia, lichen planus, oral submucous fibrosis, actinic (solar) elastosis and cervical dysplasia.

Cancers treated in some embodiments include non-cancerous or benign tumors, e.g., of endodermal, ectodermal or mesenchymal origin, including, but not limited to cholangioma, colonic polyp, adenoma, papilloma, cystadenoma, liver cell adenoma, hydatidiform mole, renal tubular adenoma, squamous cell papilloma, gastric polyp, hemangioma, osteoma, chondroma, lipoma, fibroma, lymphangioma, leiomyoma, rhabdomyoma, astrocytoma, nevus, meningioma, and ganglioneuroma.

EXAMPLES

Example 1

*Bifidobacterium animalis* ssp. *lactis* Production

Enriched media is used to grow and prepare *Bifidobacterium animalis* ssp. *lactis* for in vitro and in vivo use. For example, media may contain sugar, yeast extracts, peptones, trace elements, and vitamins. Alternatively, media may be prepared and *Bifidobacterium animalis* ssp. *lactis* grown as shown by Saarela et al., *J. Applied Microbiology*. 2005. 99: 1330-1339, which is hereby incorporated by reference. Influence of fermentation time, cryoprotectant and neutralization of cell concentrate on freeze-drying survival, storage stability, and acid and bile exposure of *Bifidobacterium animalis* ssp. *lactis* cells produced without milk-based ingredients, At large scale, the media is sterilized. Sterilization may be by Ultra High Temperature (UHT) processing. The UHT processing is performed at very high temperature for short periods of time. The UHT range may be from 135-180° C. For example, the medium may be sterilized from between 10 to 30 seconds at 135° C.

Inoculum can be prepared in flasks or in smaller bioreactors and growth is monitored. For example, the inoculum size may be between approximately 0.5 and 3% of the total bioreactor volume. Depending on the application and need for material, bioreactor volume can be at least 2 L, 10 L, 80 L, 100 L, 250 L, 1000 L, 2500 L, 5000 L, 10,000 L.

Before the inoculation, the bioreactor is prepared and ready with medium at desired pH, temperature, and oxygen concentration. For example, pH may be set between 4.5 and 8.0 During the fermentation the pH can be controlled through the use of sodium hydroxide, potassium hydroxide, or ammonium hydroxide. The temperature may be controlled from 25° C. to 45° C., for example at 37° C. Anaerobic conditions are created by reducing the level of oxygen in the culture broth from around 8 mg/L to 0 mg/L. For example, nitrogen or gas mixtures (N2, CO2, and H2) may be used in order to establish anaerobic conditions. Alternatively, no gases are used and anaerobic conditions are established by cells consuming remaining oxygen from the medium. Depending on strain and inoculum size, the bioreactor fermentation time can vary. For example, fermentation time can vary from approximately 5 hours to 48 hours.

Harvesting can be performed by continuous centrifugation. Product will be resuspended with various excipients to a desired final concentration. Excipients can be added for cryo protection or for protection during lyophilization. Excipients can include, but are not limited to, sucrose, trehalose, or lactose, and these may be alternatively mixed with buffer and antioxidants. Prior to lyophilization, droplets of cell pellets mixed with excipients are submerged in liquid nitrogen.

Lyophilization of material, including live bacteria, begins with primary drying. During the primary drying phase, the ice is removed. Here, a vacuum is generated and an appropriate amount of heat is supplied to the material for the ice to sublime. During the secondary drying phase, product bound water molecules are removed. Here, the temperature is raised higher than in the primary drying phase to break any physico-chemical interactions that have formed between the water molecules and the product material. The pressure may also be lowered further to enhance desorption during this stage. After the freeze-drying process is complete, the chamber may be filled with an inert gas, such as nitrogen. The product may be sealed within the freeze dryer under dry conditions, preventing exposure to atmospheric water and contaminants.

Example 2

Orally Administered *Bifidobacterium animalis* ssp. *lactis* Inhibits Colorectal Carcinoma Tumor Growth Female 6-8 week old Balb/c mice were obtained from Taconic (Germantown, N.Y.). 100,000 CT-26 colorectal tumor cells (ATCC CRL-2638) were resuspended in sterile PBS and inoculated in the presence of 50% Matrigel. CT-26 tumor cells were subcutaneously injected into one hind flank of each mouse. When tumor volumes reached an average of 100 mm$^3$ (approximately 10-12 days following tumor cell inoculation), animals were distributed into the following groups: 1) Vehicle+isotype control antibody IgG2a; and 3) *Bifidobacterium animalis* ssp. *lactis* Strain A (ATCC accession number PTA-125097)+IgG2a. *Bifidobacterium animalis* ssp. *lactis* bacteria (1×10$^9$) were administered by oral gavage (p.o.) daily, starting on day 1 until the conclusion of the study. The *Bifidobacterium animalis* ssp. *lactis*+IgG2a group showed significant tumor growth inhibition compared to the vehicle+IgG2a group (See FIG. 1).

Example 3

Figure 2:
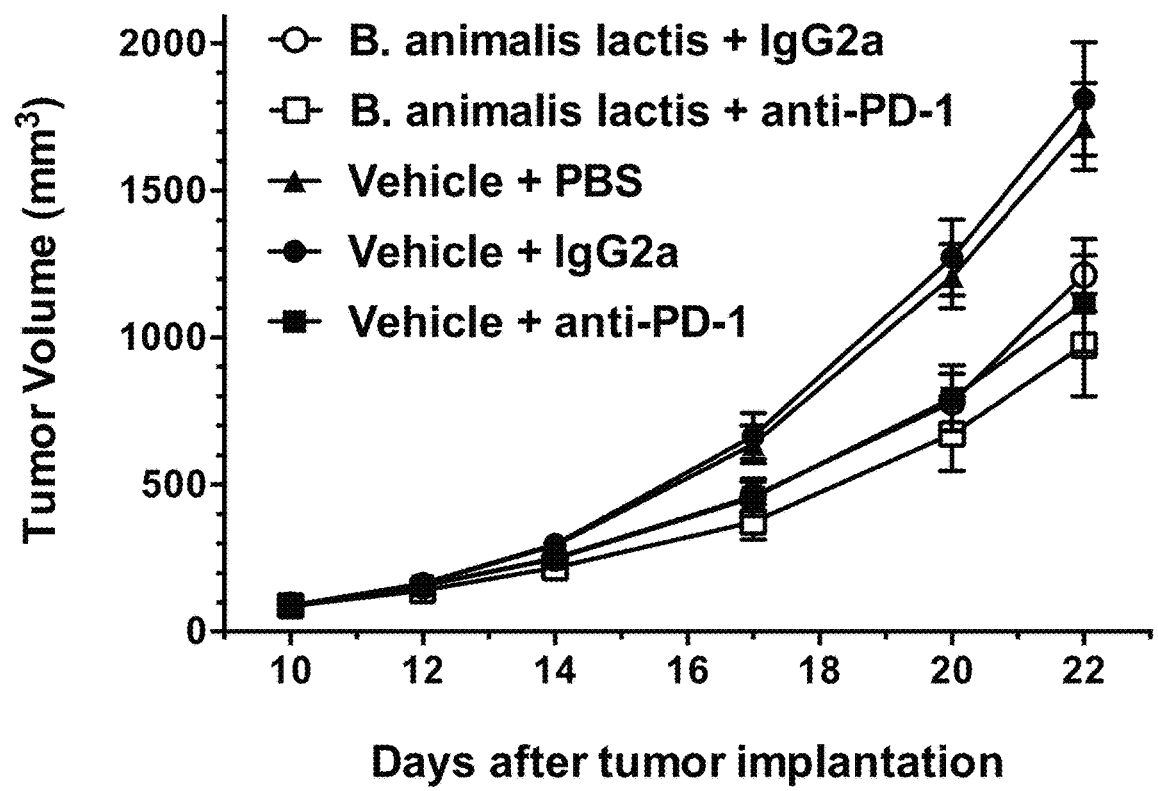
FIG. 2 shows that in a mouse colorectal carcinoma model, the efficacy of orally administered *Bifidobacterium animalis* ssp. *lactis* Strain A is comparable to that of intraperitoneally (i.p.) administered anti-PD-1.

Orally Administered *Bifidobacterium animalis* ssp. *lactis* Inhibits Colorectal Carcinoma Tumor Growth Comparable to Inhibition seen with Anti-PD-1 Treatment CT-26 tumor cells were subcutaneously injected into one hind flank of each Balb/c mouse as above. When tumor volumes reached an average of 100 mm$^3$ (approximately 10-12 days following tumor cell inoculation), animals were distributed into the following groups: 1) Vehicle+PBS; 2) Vehicle+isotype control antibody IgG2a; and 3) Vehicle+anti-PD-1; 4) *Bifidobacterium animalis* ssp. *lactis* Strain A (ATCC accession number PTA-125097)+IgG2a; and 5) *Bifidobacterium animalis* ssp. *lactis* Strain A+anti-PD-1. Antibodies were administered intraperitoneally (i.p.) at 100 ug/mouse (100 ul final volume) every four days, starting on day 1, and *Bifidobacterium animalis* ssp. *lactis* bacteria (1×10$^9$) were administered by oral gavage (p.o.) daily, starting on day 1 until the conclusion of the study. The *Bifidobacterium animalis* ssp. *lactis*+IgG2a group showed tumor growth inhibition comparable to that seen in the vehicle+anti-PD-1 group (See FIG. 2).

Example 4

Figure 3:
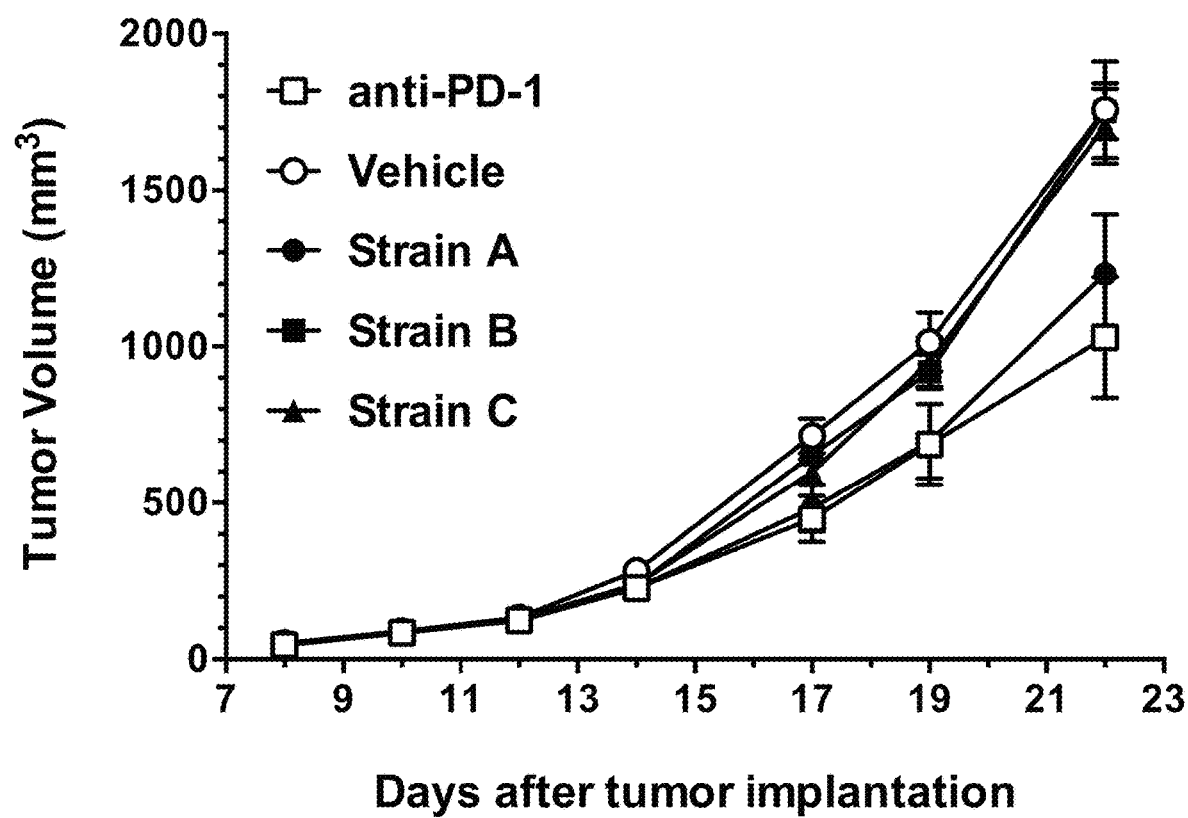
FIG. 3 shows that in a mouse colorectal carcinoma model, the efficacy of orally administered *Bifidobacterium animalis* ssp. *lactis* Strain A is comparable to that of intraperitoneally (i.p.) administered anti-PD-1.

Treatment of Colorectal Carcinoma using Different *Bifidobacterium animalis* ssp. *lactis* Strains As described in Examples 2 and 3, CT-26 tumor cells were subcutaneously injected into one hind flank of mice and animals were assigned into groups receiving the following treatments: 1) Vehicle; 2) *Bifidobacterium animalis* ssp. *lactis* Strain A (ATCC accession number PTA-125097); 3) *B. animalis lactis* Strain B; 4) *B. animalis* ssp. *lactis* Strain C; and 5) anti-PD-1. 1×10$^9$ bacterial cells were administered daily (p.o.), beginning on day 1 of animal group assignment, and tumors measured as described above. Anti-PD-1 antibodies were administered intraperitoneally (i.p.) at 100 ug/mouse (100 ul final volume) every four days, starting on day 1. As seen in Table 2, Strain A showed significant tumor growth inhibition compared to the other *B. animalis lactis* treatment groups (Table 2 and FIG. 3).

TABLE 2

| | Colorectal carcinoma tumor volume (mm$^3$) on Day 22 (12$^{th}$ day of dosing) | | | | |
|---|---|---|---|---|---|
| | Anti PD-1 | Vehicle | Strain C | Strain B | Strain A |
| Median tumor vol. (mm$^3$) | 1096.97 | 1775.89 | 1294.94 | 1819.68 | 1788.83 |
| Mean tumor vol. (mm$^3$) | 1029.97 | 1757.75 | 1231.34 | 1753.12 | 1704.33 |
| SEM (mm$^3$) | 193.37 | 154.75 | 190.00 | 89.48 | 119.03 |

Example 5

Figure 4:
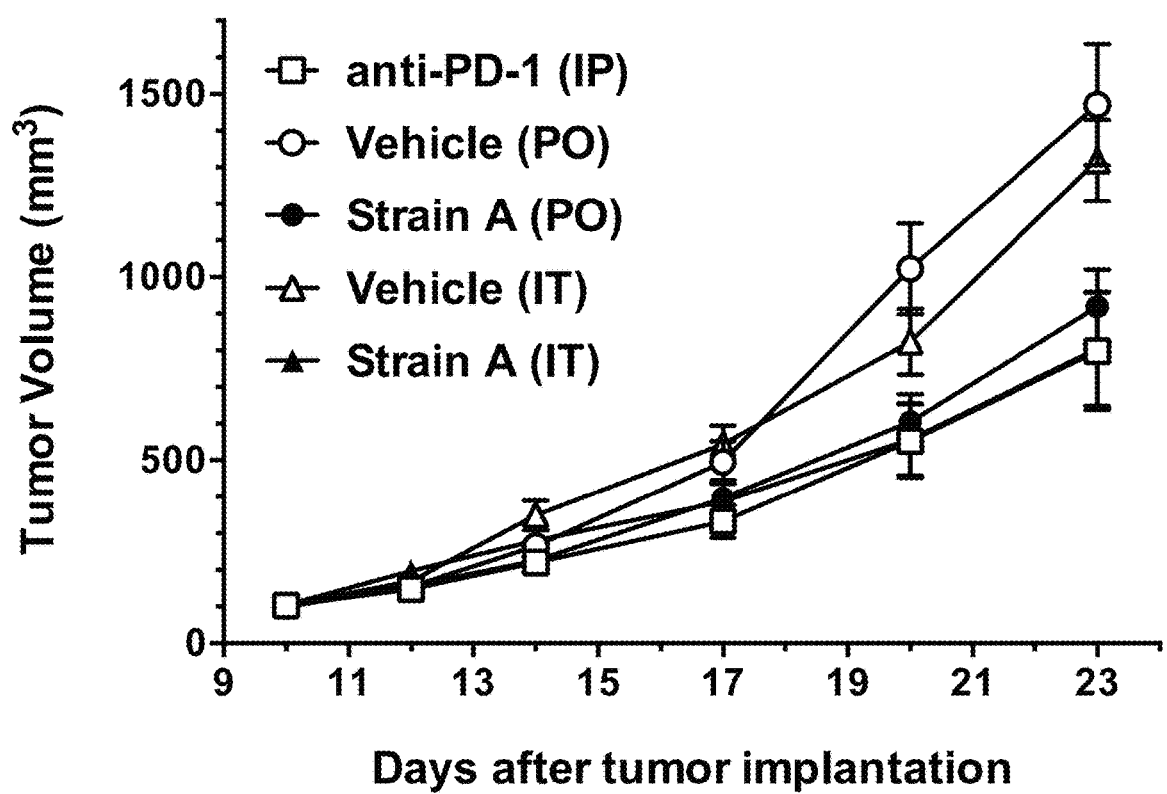
FIG. 4 shows that in a mouse colorectal carcinoma model, the efficacy of intratumorally *Bifidobacterium animalis* ssp. *lactis* Strain A is comparable to that of intraperitoneally (i.p.) administered anti-PD-1.

Intratumorally Administered *Bifidobacterium animalis* ssp. *lactis* Inhibits Colorectal Carcinoma Tumor Growth As described in Examples 2 and 3, CT-26 tumor cells were subcutaneously injected into one hind flank of mice and animals were assigned into groups receiving the following treatments: 1) Vehicle; 2) *Bifidobacterium animalis* ssp. *lactis* Strain A (ATCC accession number PTA-125097); and 3) anti-PD-1. 2×10$^9$ bacterial cells were administered intratumorally (IT) on day 1 of animal group assignment, and tumors measured as described above. Mice received a second dose on day 4. Anti-PD-1 antibodies were administered intraperitoneally (i.p.) at 100 ug/mouse (100 ul final volume) every four days, starting on day 1. The *Bifidobacterium animalis* ssp. *lactis* Strain A group showed significant tumor growth inhibition compared to the control group (See FIG. 4).

Example 6

*Bifidobacterium animalis* ssp. *lactis* in a Mouse Melanoma Model

*B. animalis* ssp. *lactis* is tested for efficacy in a mouse melanoma model. For example, Female 6-8 week old C57Bl/6 mice are obtained from Taconic (Germantown, N.Y.). Between 1×10^4 and 1×10^6 B16-F10 tumor cells (ATCC CRL-6475) may be used to inoculate various groups of mice. B16-F10 tumor cells may be resuspended in sterile PBS containing 50% Matrigel and inoculated in a 100 ul final volume into one hind flank (the first flank) of each mouse. Treatment with *Bifidobacterium animalis* ssp. *lactis* is initiated at some point following tumor cell inoculation at varied doses and at defined intervals. For example, some mice receive between 1-5×10^9 CFU (100 μl final volume) per dose. Possible routes of administration include oral gavage (p.o.), intravenous injection, intratumoral injection (IT) or peritumoral or subtumoral or subcutaneous injection. In order to assess the systemic anti-tumoral effects of *B. animalis lactis* treatment, additional mice may be inoculated with tumor cells in the contralateral (untreated, second) flank prior to IT, peritumoral, or subtumoral treatment with *B. animalis lactis* in the first flank.

Some mice may receive *Bifidobacterium animalis* ssp. *lactis* (p.o.) on day 1 (the day following tumor cell injection). Other mice may receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly. For example, when tumor volumes reach an average of 100 mm$^3$ (approximately 10-12 days following tumor cell inoculation), animals are distributed into groups and treated with either vehicle or *Bifidobacterium animalis* ssp. *lactis* (p.o. or IT). Some additional groups of mice may be treated with an additional cancer therapeutic or appropriate control antibody. One example of a cancer therapeutic that may be administered is an inhibitor of an immune checkpoint, for example anti-PD-1, anti-PD-L1, or other treatment that blocks the binding of an immune checkpoint to its ligand(s). Checkpoint inhibitors anti-PD-1 and anti-PD-L1 may be formulated in PBS and administered intraperitoneally (i.p.) in effective doses. For example, mice are given 100 ug of anti-PD-1 (i.p.) every four days starting on day 1, and continuing for the duration of the study.

In addition, some mice are treated with antibiotics prior to treatment. For example, vancomycin (0.5 g/L), ampicillin (1.0 g/L), gentamicin (1.0 g/L) and amphotericin B (0.2 g/L) are added to the drinking water, and antibiotic treatment is halted at the time of treatment or a few days prior to treatment. Some mice are inoculated with tumor cells without receiving prior treatment with antibiotics. Also, in some groups the B16-f10 cells may be cultured with 100 U/ml penicillin and 10 mg/ml streptomycin prior to inoculation.

For example, B16-F10 cells were expanded using standard tissue culture technique, maintained in DMEM medium supplemented with 10% fetal bovine serum (FBS), 100 U/ml penicillin, and 10 mg/ml streptomycin in a 37° C. incubator with 5% CO2. On the day of tumor cell implantation, B16-F10 cells were resuspended in cold HBSS at 1×10^6 tumor cells/ml and each mouse was injected with 100 ul of resuspended tumor cells. Tumor growth was measured three times per week using digital calipers according to methods known in the art. When the average tumor size reached approximately 100 mm$^3$, mice were randomly separated into treatment groups and treatment initiated according to Table 3 below.

TABLE 3

Treatments

| Group, N = 20 | Treatment #1 | Treatment #2 |
|---|---|---|
| 1 | Vehicle (PO, 100 μL vol. QD) | PBS (IP, 100 μL, Q4D) |
| 2 | Vehicle (PO, 100 μL vol. QD) | anti-PD-L1 (IP, 200 μg/100 μL vol, Q4D) |
| 3 | *B. animalis* ssp. *lactis* Strain A (PO, 6.5 × 10^9 CFU in 100 μL vol. QD) | PBS (IP, 100 μL, Q4D) |
| 4 | *B. animalis* ssp. *lactis* Strain A (PO, 6.5 × 10^9 CFU in 100 μL vol. QD) | anti-PD-L1 (IP, 200 μg/100 μL vol, Q4D) |

Figure 5:
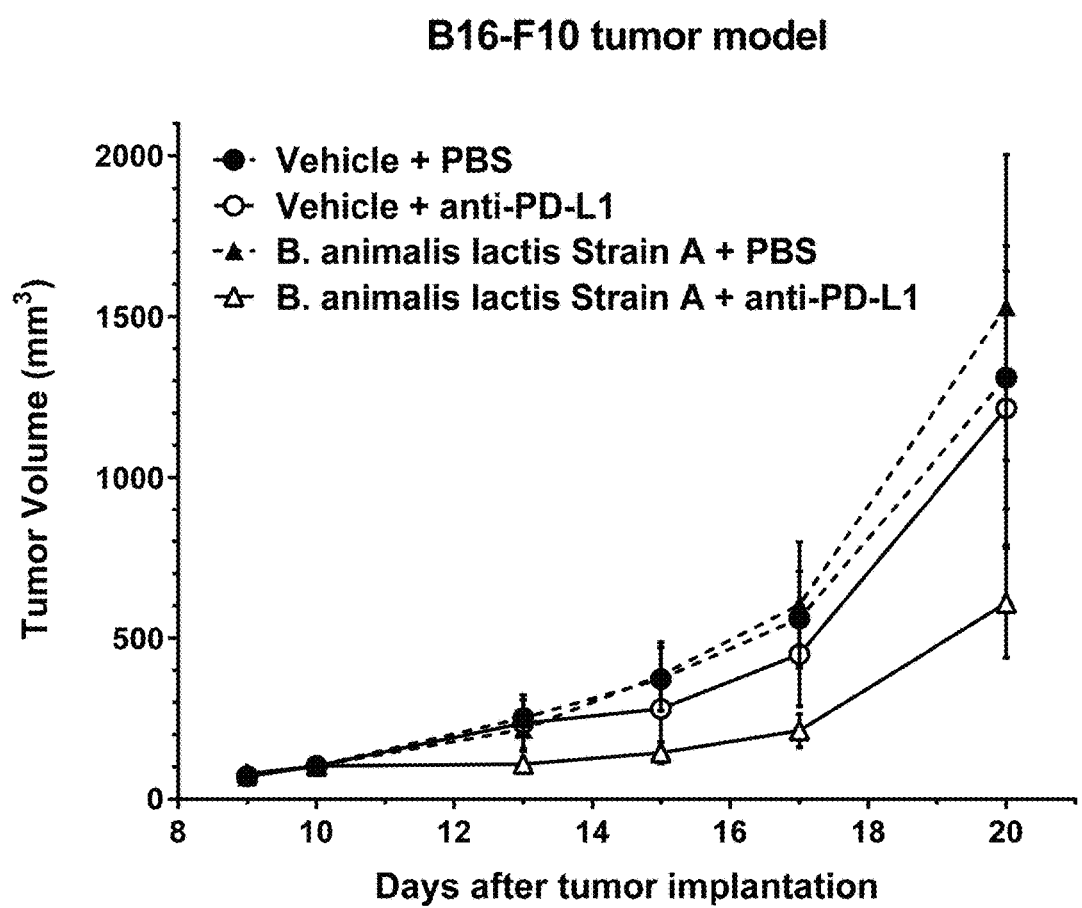
FIG. 5 shows that in a mouse melanoma model, treating tumor-inoculated mice with a combination of *Bifidobacterium animalis* ssp. *lactis* Strain A and anti-PD-L1 inhibits tumor growth in a manner superior to either *B. animalis* ssp. *lactis* Strain A or anti-PD-L1 alone.

Animals received Treatment #1 (Vehicle or *B. animalis* ssp. *lactis* Strain A) via oral gavage every day. Mice received Treatment #2 (PBS or anti-PD-L1 intraperitoneally every 4 days until the termination of the study. Treating tumor-inoculated mice with a combination of *Bifidobacterium animalis* ssp. *lactis* Strain A and anti-PD-L1 inhibits tumor growth in a manner superior to either *B. animalis* ssp. *lactis* Strain A or anti-PD-L1 alone (FIG. 5).

Example 7

Infiltration of CD3+ Cells is Significantly Increased in CT26 Tumors in Mice Orally Savaged with *B. animalis lactis* Strain A In some studies, at various timepoints, mice are sacrificed and tumors, lymph nodes, or other tissues may be removed for ex vivo flow cytometric analysis using methods known in the art. For example, tumors are dissociated using a Miltenyi tumor dissociation enzyme cocktail according to the manufacturer's instructions. Tumor weights are recorded and tumors are chopped then placed in 15 ml tubes containing the enzyme cocktail and placed on ice. Samples are then placed on a gentle shaker at 37° C. for 45 minutes and quenched with up to 15 ml complete RPMI. Each cell suspension is strained through a 70 μm filter into a 50 ml falcon tube and centrifuged at 1000 rpm for 10 minutes. Cells are resuspended in FACS buffer and washed to remove remaining debris. If necessary, samples are strained again through a second 70 μm filter into a new tube. Cells are stained for analysis by flow cytometry using techniques known in the art. Staining antibodies can include anti-CD11c (dendritic cells), anti-CD80, anti-CD86, anti-CD40, anti-MHCII, anti-CD8a, anti-CD4, and anti-CD103. Other markers that may be analyzed include pan-immune cell marker CD45, T cell markers (CD3, CD4, CD8, CD25, Foxp3, T-bet, Gata3, Roryt, Granzyme B, CD69, PD-1, CTLA-4), and macrophage/myeloid markers (CD11b, MHCII, CD206, CD40, CSF1R, PD-L1, Gr-1). In addition to immunophenotyping, cytokines are analyzed including, but not limited to, IP-10, TNFa, IL-17, IL-13, IL-12p70, IL12p40, IL-10, IL-6, IL-5, IL-4, IL-2, IL-1b, IFNy, GM-CSF, G-CSF, M-CSF, MIG, IP10, MIP1b, RANTES, and MCP-1, using techniques known in the art. Cytokine analysis may be analyzed on immune cells obtained from lymph nodes or other tissue, tumor sections, dissociated tumor cells, and/or on purified CD45+ tumor-infiltrated immune cells obtained ex vivo. Cytokine levels may be ascertained using various staining techniques, qPCR, or other techniques known in the arts. Immunohistochemistry may also be performed on tumor sections to measure T cells, macrophages, dendritic cells, and checkpoint molecule or other protein expression using techniques known in the art.

Mice were inoculated with CT26 tumor cells, divided into groups as described above, and orally gavaged with *B. animalis* ssp. *lactis* Strain A 8.3×10^9 CFU/mouse daily. Other mice were given vehicle as a negative control. Mice from this study were sacrificed on day 10 and tumors harvested for analysis. Using known techniques described above, tumor sections were stained with anti-CD3 antibodies (T cell marker) to assess the average CD3+ cells per tumor section, and tumor gene expression was analyzed by qPCR using a TaqMan assay as follows: Tumor RNA was isolated with Qiagen's RNeasy Mini kit (Catalog No. 74104), using the manufacturer's protocol. cDNA was isolated using BioRad's iScript™ cDNA Synthesis Kit according to the manufacturer's protocol (Catalog No. 1708891). The qPCR reaction was run using SsoAdvanced™ Universal Probes Supermix 1725281 using manufacturer's protocol on the BioRad CFX384 instrument. The TaqMan mouse specific probes were from Invitrogen, MHC I (b2m) Mm00437762_ml and β-actin Mm01205647_g1 for normalizing gene expression. The delta Ct value for each tumor was calculated for MHC I using β-actin as the reference gene. The expression for MHC I was calculated using the formula 2^-delta Ct for each mouse tumor and this value was divided by its respective final tumor volume at the end of the study.

Figure 6A:
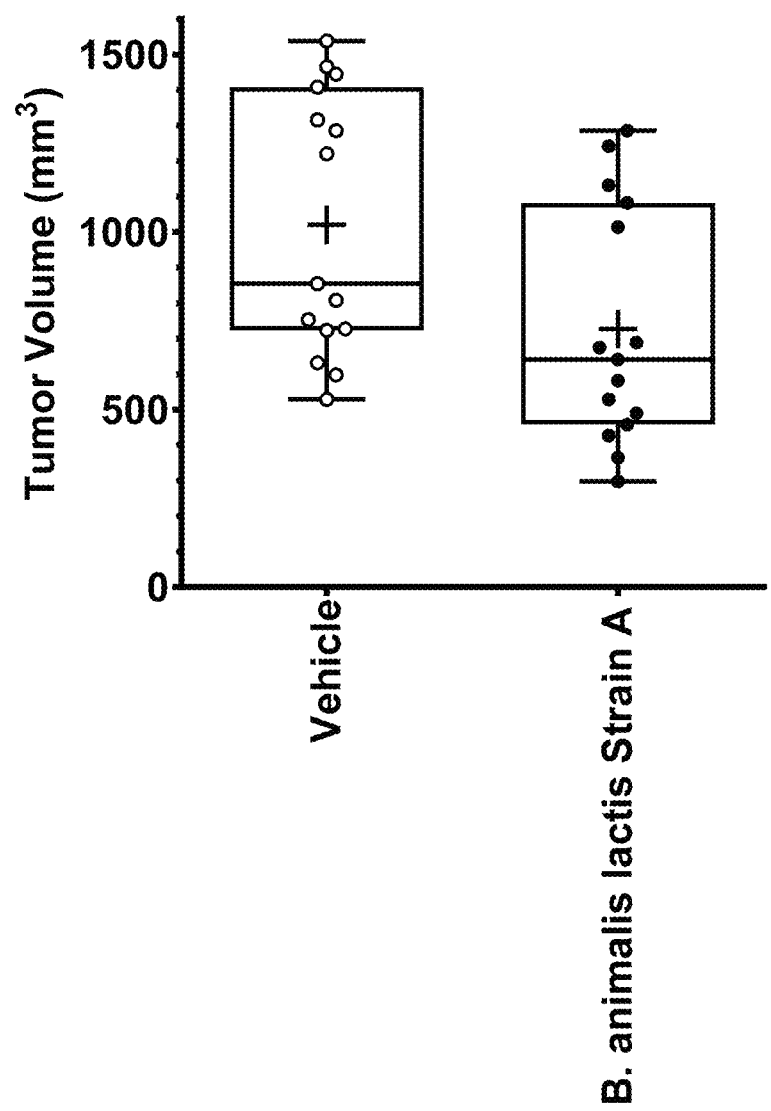
FIG. 6A shows the tumor volume prior to CD3+ immune cell infiltrate and MEW Class I expression analysis.
Figure 6B:
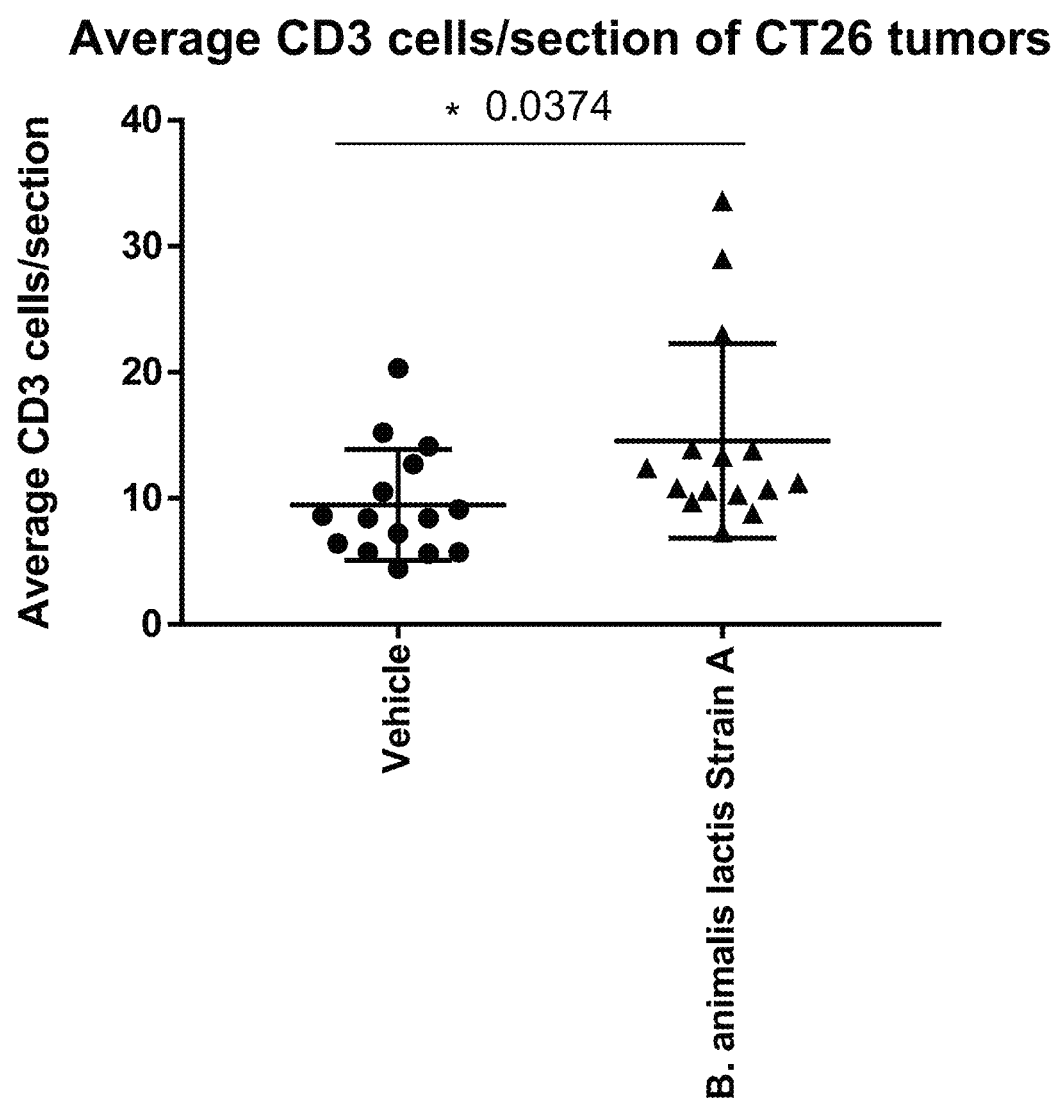
FIG. 6B shows the infiltration of CD3+ immune cells was significantly increased in the *Bifidobacterium animalis* ssp. *lactis* Strain A group relative to the vehicle group.
Figure 6C:
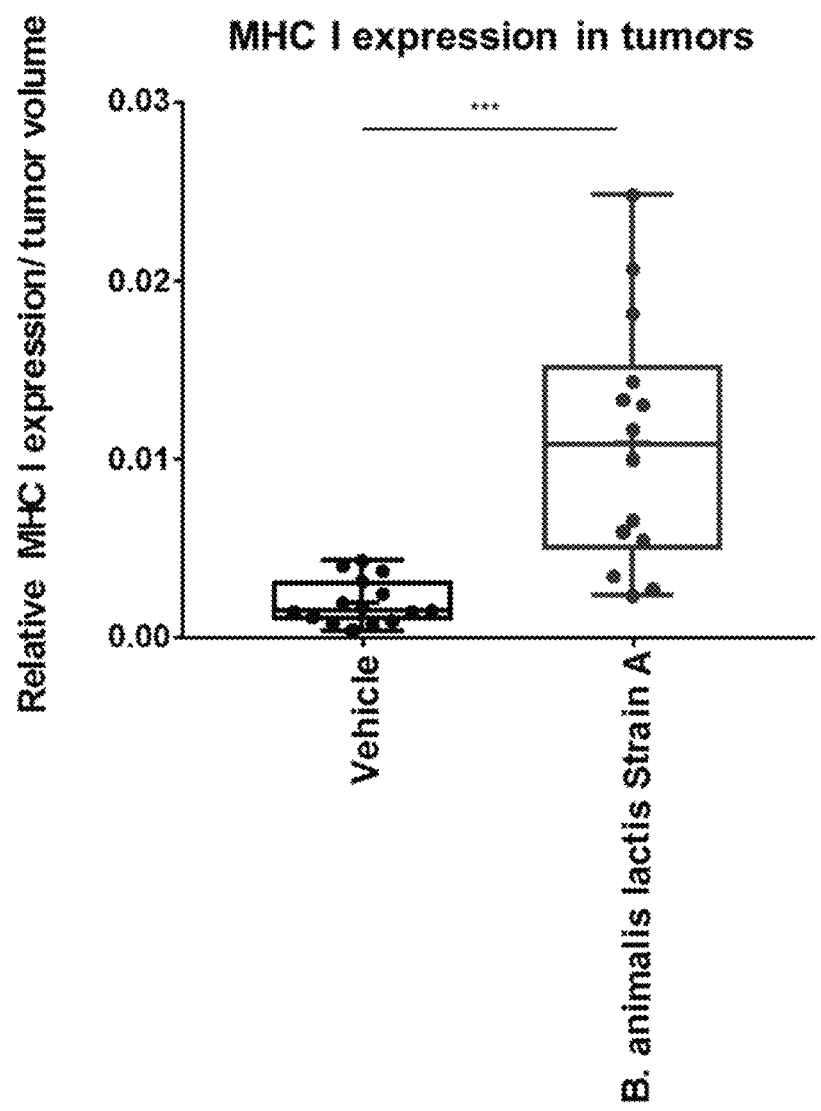
FIG. 6C shows that *Bifidobacterium animalis* ssp. *lactis* Strain A induced a striking upregulation of MEW Class I expression relative to the vehicle group.

Tumor volumes were taken prior to CD3+ immune cell infiltrate and MHC Class I expression analysis. As described in FIG. 1, tumor volume was notably decreased on day 9 in the *B. animalis* ssp. *lactis* group (FIG. 6A). Infiltration of CD3+ immune cells was significantly increased in the *Bifidobacterium animalis* ssp. *lactis* Strain A group relative to vehicle (FIG. 6B), and *B. animalis* ssp. *lactis* Strain A induced a striking upregulation of MHC Class I expression (FIG. 6C).

Rather than being sacrificed, some mice may be rechallenged with tumor cell injection into the contralateral flank (or other area) to determine the impact of the immune system's memory response on tumor growth.

Example 8

*Bifidobacterium animalis* ssp. *lactis* in a Mouse Lung Cancer Model

*Bifidobacterium animalis* ssp. *lactis* is tested for its efficacy in the mouse lung cancer model, either alone or in combination with other cancer therapies, including checkpoint inhibitor(s). Mice are divided into groups receiving *Bifidobacterium animalis* ssp. *lactis*, with or without checkpoint inhibitor treatment. As described in Example 6, *Bifidobacterium animalis* ssp. *lactis* is administered at varied doses at defined intervals. For example, some mice receive *Bifidobacterium animalis* ssp. *lactis* (p.o.) on the day following tumor cell injection (day 1). Some mice receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly.

$1 \times 10^6$ LLC1 cells, or an appropriate number of lung cancer cells from another lung cancer cell line, are injected into the hind flank of syngeneic mice. Tumors from the various treatment groups are measured with calipers at regular intervals. As described in Example 6, some mice are sacrificed for ex vivo tumor analysis using flow cytometry. Other mice may be rechallenged with tumor cell injection into the contralateral flank to determine the impact of the immune system's memory response on tumor growth.

Example 9

*Bifidobacterium animalis* ssp. *lactis* in a Mouse Breast Cancer Model

*Bifidobacterium animalis* ssp. *lactis* is tested for its efficacy in the mouse breast cancer model, either alone or in combination with other cancer therapies, including checkpoint inhibitor(s). Mice are divided into groups receiving *Bifidobacterium animalis* ssp. *lactis*, with or without checkpoint inhibitor treatment. As described in Example 6, *Bifidobacterium animalis* ssp. *lactis* is administered at varied doses at defined intervals. For example, some mice receive *Bifidobacterium animalis* ssp. *lactis* (p.o.) on the day following tumor cell injection (day 1). Some mice receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly.

4T1 mouse mammary carcinoma cells are obtained from ATCC and $1 \times 10^6$ cells in 50 ul PBS are injected subcutaneously into one or both hind limbs of Balb/c female mice (as described by Wang et al. 2003, Systemic dissemination of viral vectors during intratumoral injection. Molecular Cancer Therapeutics; 2(11)). Alternatively, EMT6 mouse mammary carcinoma cells are obtained from ATCC and $1 \times 10^6$ cells in 50 μl PBS are injected subcutaneously into one or both of the hind limbs of Balb/c female mice 6-8 weeks old (as described by Guo et al. 2014, Combinatorial Photothermal and Immuno Cancer Therapy Using Chitosan-Coated Hollow Copper Sulfide Nanoparticles. ASC Nano.; 8(6): 5670-5681). In addition, other available mouse mammary cell lines may be used.

Tumors from the various treatment groups are measured with calipers at regular intervals. As described in Example 6, *Bifidobacterium animalis* ssp. *lactis* is administered at varied doses at defined intervals. For example, some mice are sacrificed for ex vivo tumor analysis using flow cytometry. Other mice may be rechallenged with tumor cell injection into the contralateral flank to determine the impact of the immune system's memory response on tumor growth.

Alternatively, 4T1 cells can be used in an orthotopic murine model of breast cancer as described by Tao et al. (Tao et al. 2008. Imagable 4T1 model for the study of late stage breast cancer. 8: 288). Mice are sacrificed for ex vivo tumor analysis. Tumors are analyzed by flow cytometry and immunohistochemistry.

Example 10

*Bifidobacterium animalis* ssp. *lactis* in a Mouse Pancreatic Cancer Model

*Bifidobacterium animalis* ssp. *lactis* is tested for its efficacy in the mouse model of pancreatic cancer, either alone or in combination with other cancer therapies, including checkpoint inhibitor(s). Mice are divided into groups receiving *Bifidobacterium animalis* ssp. *lactis*, with or without checkpoint inhibitor treatment. As described in Example 6, some mice receive *Bifidobacterium animalis* ssp. *lactis* (p.o.) on the day following tumor cell injection (day 1). Some mice receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly.

Panc02 cells are maintained in DMEM, supplemented with 10% fetal calf serum and 1% penicillin/streptomycin, and incubated at 37° C. at 5% CO2. Female 8-10 week-old C57Bl/6 mice are obtained from Charles River, Inc. or other certified vendor. Female C57Bl/6 mice are injected subcutaneously into the right hind flank with $1 \times 10^6$ Panc02 cells. This protocol is based on standard Panc02 tumor models (Maletzki et al. 2008. Pancreatic cancer regression by intratumoral injection of live *streptococcus* pyogenes in a syngeneic mouse model. Gut. 57:483-491). Tumors from the various treatment groups are measured with calipers at regular intervals. As described in Example 6, some mice are sacrificed for ex vivo tumor analysis using flow cytometry, while other mice are rechallenged to determine the impact of the memory response on tumor growth.

Alternatively, Panc02, 6606PDA, or Capan-1 cells lines can be used in an orthotopic murine model of pancreatic cancer as described by Partecke et al. (Partecke et al. 2011. A syngeneic orthotopic murine model of pancreatic adenocarcinoma in the C57/B16 mouse using the Panc02 and 6606PDA cell lines. Eur. Surg. Res. 47(2):98-107) or Chai et al. (Chai et al. 2013. Bioluminescent orthotopic model of pancreatic cancer progression. J. Vis. Exp. 76: 50395). Mice are sacrificed for ex vivo tumor analysis. Tumors are analyzed by flow cytometry and immunohistochemistry.

Example 11

*Bifidobacterium animalis* ssp. *lactis* in a Mouse Model of Hepatocellular Carcinoma

*Bifidobacterium animalis* ssp. *lactis* is tested for its efficacy in the mouse model of hepatocellular carcinoma, either alone or in combination with other cancer therapies, including checkpoint inhibitor(s). Mice are divided into groups receiving *Bifidobacterium animalis* ssp. *lactis*, with or without checkpoint inhibitor treatment. As described in Example 6, *Bifidobacterium animalis* ssp. *lactis* is administered at varied doses at defined intervals. For example, some mice receive *Bifidobacterium animalis* ssp. *lactis* (p.o.) on the day following tumor cell injection (day 1). Some mice receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly.

Hepatocellular carcinoma is induced in mice by subcutaneous inoculation of 1×10$^6$ Hepa129 cells (obtained from NCI or other source), or an appropriate number of cells from other hepatocellular carcinoma cell line (as described by Gonzalez-Carmona et al. 2008. CD40 ligand-expressing dendritic cells induce regression of hepatocellular carcinoma by activating innate and acquired immunity in vivo. Hepatology. 48(1):157-168). Tumor cells are inoculated into one or both flanks. Tumors from the various treatment groups are measured with calipers at regular intervals. As described in Example 6, some mice are sacrificed for ex vivo tumor analysis using flow cytometry, while other mice are rechallenged to determine the impact of the memory response on tumor growth.

Example 12

*Bifidobacterium animalis* ssp. *lactis* in a Mouse Lymphoma Model

*Bifidobacterium animalis* ssp. *lactis* is tested for its efficacy in the mouse model of lymphoma, either alone or in combination with other cancer therapies, including checkpoint inhibitor(s). Mice are divided into groups receiving *Bifidobacterium animalis* ssp. *lactis*, with or without checkpoint inhibitor treatment. As described in Example 6, *Bifidobacterium animalis* ssp. *lactis* is administered at varied doses at defined intervals. For example, some mice receive *Bifidobacterium animalis* ssp. *lactis* (p.o.) on the day following tumor cell injection (day 1). Some mice receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly.

One lymphoma cell line is the A20 lymphoma, although other lymphoma cell lines may be used with syngeneic mice. A20 lymphoma cells are obtained from ATCC and 5×10$^6$ cells in 50 ul PBS are injected subcutaneously into one or both of the hind limbs of Balb/c female mice (as described by Houot et al. 2009. T-cell modulation combined with intratumoral CpG cures lymphoma in a mouse model without the need for chemotherapy. Blood. 113(15): 3546-3552). Tumors from the various treatment groups are measured with calipers at regular intervals. As described in Example 6, some mice are sacrificed for ex vivo tumor analysis using flow cytometry, while other mice are rechallenged to determine the impact of the memory response on tumor growth.

Example 13

*Bifidobacterium animalis* ssp. *lactis* in a Mouse Prostate Cancer Model

*Bifidobacterium animalis* ssp. *lactis* is tested for its efficacy in the mouse model of prostate cancer, either alone or in combination with other cancer therapies, including checkpoint inhibitor(s). Mice are divided into groups receiving *Bifidobacterium animalis* ssp. *lactis*, with or without checkpoint inhibitor treatment. As described in Example 6, *Bifidobacterium animalis* ssp. *lactis* is administered at varied doses at defined intervals. For example, some mice receive *Bifidobacterium animalis* ssp. *lactis* (p.o.) on the day following tumor cell injection (day 1). Some mice receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly.

Mouse prostate cancer cells (1×10$^5$ RM-1 cells or an appropriate number of cells from another prostate cancer cell line) are injected into syngeneic mice. Tumors from the various treatment groups are measured with calipers at regular intervals. As described in Example 6, some mice are sacrificed for ex vivo tumor analysis using flow cytometry, while other mice are rechallenged to determine the impact of the memory response on tumor growth.

Example 14

*Bifidobacterium animalis* ssp. *lactis* in a Mouse Plasmacytoma Model

*Bifidobacterium animalis* ssp. *lactis* is tested for its efficacy in the mouse model of plasmacytoma, either alone or in combination with other cancer therapies, including checkpoint inhibitor(s). Mice are divided into groups receiving *Bifidobacterium animalis* ssp. *lactis*, with or without checkpoint inhibitor treatment. As described in Example 6, *Bifidobacterium animalis* ssp. *lactis* is administered at varied doses at defined intervals. For example, some mice receive *Bifidobacterium animalis* ssp. *lactis* (p.o.) on the day following tumor cell injection (day 1). Some mice receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly.

Mineral Oil Induced Model of Plasmacytoma

To examine the efficacy of *Bifidobacterium animalis* ssp. *lactis* in a plasmacytoma or multiple myeloma model, mice are injected intraperitoneally three times with 500 ul of 2,6,10,12-tetramethylpentadecane ("pristane oil") at various time points between 0 and 60 days, as described by Potter et al. 1983. Peritoneal plasmacytomagenesis in mice: comparison of different pristane dose regimens. J. Natl. Cancer Inst. 71(2):391-5 (see also Lattanzio et al. 1997. Defective Development of Pristane-Oil Induced Plasmacytomas in Interleukin-6-Deficient BALB/C Mice. Am. J. Pathology: 151(3): 689696). Progression of disease is measured by the degree of abdominal swelling and immune cells and particles in the ascites. Ascites fluid is analyzed for immune cell phenotype by flow cytometry as described in Example 2.

Cell-line Induced Model of Plasmacytoma

To examine the efficacy of *Bifidobacterium animalis* ssp. *lactis* in a plasmacytoma or multiple myeloma model, either MOPC-104E cells or J558 plasmacytoma cells (TIB-6 ATCC) are injected subcutaneously into one or more hind flanks of Balb/c mice (5×10$^6$ cells), based on model described by Bhoopalam et al. 1980. Effect of dextran-S (alpha, 1-3 dextran) on the growth of plasmacytomas MOPC-104E and J558. J. Immunol. 125(4):1454-8 (see also Wang et al. 2015. IL-10 enhances CTL-mediated tumor rejection by inhibiting highly suppressive CD4+ T cells and promoting CTL persistence in a murine model of plasmacytoma. OncoImmunology. 4(7): e1014232-1-9). Mice are divided into groups receiving *Bifidobacterium animalis* ssp. *lactis* by oral gavage, and with or without checkpoint inhibitor treatment. Tumors from the various treatment groups are measured with calipers at regular intervals. As described in Example 6, some mice are sacrificed for ex vivo tumor analysis using flow cytometry, while other mice are rechallenged to determine the impact of the memory response on tumor growth.

Example 15: *Bifidobacterium animalis* ssp. *lactis* in a SCID Mouse Model of Mouse Myeloma

*Bifidobacterium animalis* ssp. *lactis* is tested for its efficacy in the SCID mouse model of myeloma, either alone or in combination with other cancer therapies, including checkpoint inhibitor(s). Mice are divided into groups receiving *Bifidobacterium animalis* ssp. *lactis*, with or without checkpoint inhibitor treatment. As described in Example 6, *Bifidobacterium animalis* ssp. *lactis* is administered at varied doses at defined intervals. For example, some mice receive *Bifidobacterium animalis* ssp. *lactis* (p.o.) on the day following tumor cell injection (day 1). Some mice receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly.

To examine the efficacy of *Bifidobacterium animalis* ssp. *lactis* using a human plasma cell leukemia, 1×10$^7$ human myeloma cell lines, ARH77 cells (ARH77-ATCC CRL-1621, or an appropriate number of cells from another myeloma cell line such as KPMM2) are used. Myeloma cells are injected subcutaneously into one or both hind flanks of SCID mice (See Caers et al. 2004. Of mice and men: disease models of multiple myeloma. Drug Discovery Today: Disease Models. 1(4):373-380. Tumors from the various treatment groups are measured with calipers at regular intervals. As described in Example 6, some mice are sacrificed for ex vivo tumor analysis using flow cytometry, while other mice are rechallenged to determine the impact of the memory response on tumor growth.

Example 16

*Bifidobacterium animalis* ssp. *lactis* in a Mouse Renal Cell Carcinoma Model

*Bifidobacterium animalis* ssp. *lactis* is tested for its efficacy in the mouse model of renal cell carcinoma, either alone or in combination with other cancer therapies, including checkpoint inhibitor(s). Mice are divided into groups receiving *Bifidobacterium animalis* ssp. *lactis*, with or without checkpoint inhibitor treatment. As described in Example 6, *Bifidobacterium animalis* ssp. *lactis* is administered at varied doses at defined intervals. For example, some mice receive *Bifidobacterium animalis* ssp. *lactis* (p.o.) on the day following tumor cell injection (day 1). Some mice receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly.

To examine the efficacy of *Bifidobacterium animalis* ssp. *lactis* in a mouse model of renal cell carcinoma, Renca cells (ATCC CRL-2947) or other renal cell carcinoma cells are injected subcutaneously into one or both flanks of 7-8 week old syngeneic Balb/c mice (5×10$^6$ in 0.1 ml PBS). Tumors from the various treatment groups are measured with calipers at regular intervals. As described in Example 6, some mice are sacrificed for ex vivo tumor analysis using flow cytometry, while other mice are rechallenged to determine the impact of the memory response on tumor growth.

Example 17

*Bifidobacterium animalis* ssp. *lactis* in a Mouse Bladder Cancer Model

*Bifidobacterium animalis* ssp. *lactis* is tested for its efficacy in the mouse model of bladder cancer, either alone or in combination with other cancer therapies, including checkpoint inhibitor(s). Mice are divided into groups receiving *Bifidobacterium animalis* ssp. *lactis*, with or without checkpoint inhibitor treatment. As described in Example 6, *Bifidobacterium animalis* ssp. *lactis* is administered at varied doses at defined intervals. For example, some mice receive *Bifidobacterium animalis* ssp. *lactis* (p.o.) on the day following tumor cell injection (day 1). Some mice receive seven (7) consecutive doses of *Bifidobacterium animalis* ssp. *lactis* (one dose per day on days 14-21). Other mice receive daily dosing or, alternatively, some mice receive dosing every other day. Alternatively, mice are randomized into various treatment groups at a defined timepoint (e.g. on day 13) or when the tumors reach a certain size (e.g. 100 mm$^3$) and treatment is then initiated accordingly.

On the day of inoculation, MBT-2 cells (or other bladder cancer cell line) are harvested and resuspended in 1:1 PBS/Matrigel mixture. $2\times10^5$ MBT-2 cells are suspended in 100 ul of mixture and injected subcutaneously into one or both hind flanks of syngeneic mice. Tumors are measured with calipers at regular intervals.

As described in Example 6, some mice are sacrificed for ex vivo tumor analysis using flow cytometry, while other mice are rechallenged to determine the impact of the memory response on tumor growth.

Example 18

The Efficacy of a *Bifidobacterium animalis* ssp. *lactis* Strain is Compared to Other *Bifidobacterium* Strains for Efficacy in Cancer Models Using methods described above, various *Bifidobacterium animalis* ssp. *lactis* and other *Bifidobacterium* strains are tested and compared for efficacy in various cancer models. Such models may include, but are not limited to, melanoma, lung cancer, breast cancer, colon cancer, colorectal cancer, pancreatic cancer, hepatocellular cancer, lymphoma, prostate cancer, plasmacytoma, a SCID model of myeloma, renal cell carcinoma, and/or bladder cancer.

Example 19

Figure 7:
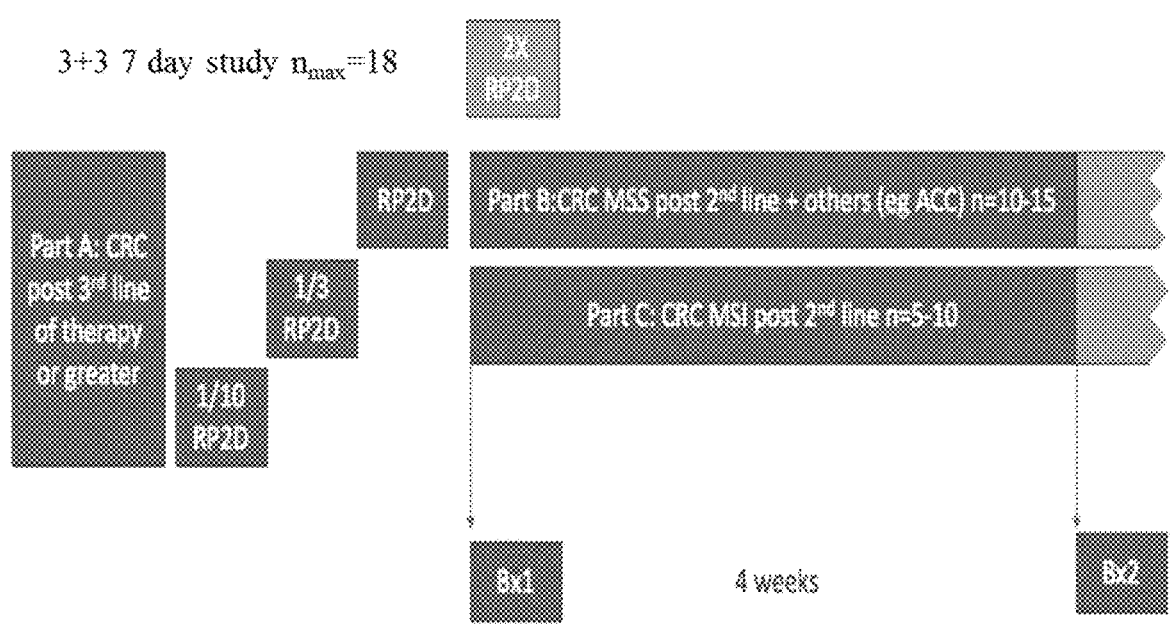
FIG. 7 shows an overview of a phase ½ open-label study of the safety, tolerability and efficacy of a *Bifidobacterium animalis* ssp. *lactis* Strain A as an oral therapeutic in patients with metastatic colorectal carcinoma.

An Open-label Study of the Safety, Tolerability and Efficacy of a *Bifidobacterium Animalis* ssp. *lactis* Strain A Oral Therapeutic in Patients with Metastatic Colorectal Carcinoma A multi-center, open-label clinical study with dose escalations and dose expansions to assess preliminary safety, tolerability, and efficacy of the *Bifidobacterium animalis* ssp. *lactis* Strain A is performed. The study proceeds in three parts: Part A: Dose escalation in microsatellite stable (MSS) metastatic colorectal carcinoma (CRC) and alternative indications, Part B: MSS CRC and alternative indications, and Part C: microsatellite instable (MSI) CRC. Dose escalation occurs in a standard 3+3 design. In part A, from 9 to 18 patients are enrolled. Parts B and C are enrolled concurrently. In Part B, up to 15 and no fewer than 10 pateints are enrolled. In Part C no fewer than 5 and up to 10 patients are enrolled. Based on in vivo studies of allograft bearing mice, an exemplary estimated human effective dose is $2\times10^{11}$ organisms per day, delivered per enteric capsule. A schematic overview of the study is depicted in FIG. 7.

The primary objectives of the study include the determination of the maximum tolerated dose within the tested dose range for *Bifidobacterium animalis* ssp. *lactis* Strain A in patients with advanced malignancies; the determination of the recommended phase 2 dose for *Bifidobacterium animalis* ssp. *lactis* Strain A in CRC; the evaluation of the safety and tolerability, including dose limiting toxicities of *Bifidobacterium animalis* ssp. *lactis* Strain; and the demonstration of anti-tumor activity of *Bifidobacterium animalis* ssp. *lactis* Strain A in patients with CRC (MSI and MSS). The anti-tumor activity will be assessed by monitoring changes in circulating tumor cells, immune cell subsets in blood and tumor, and tumor viability; objective response rate and duration of response; progression-free survival; overall survival; clinical benefit rate and duration of clinical benefit rate; and disease control rate and duration of disease control rate. The secondary objective is to determine the human distribution and elimination of *Bifidobacterium animalis* ssp. *lactis* Strain A. The exploratory objectives is to evaluate correlations of *Bifidobacterium animalis* ssp. *lactis* Strain A response with molecular markers relevant to each tumor type and to identify possible mechanisms of resistance to *Bifidobacterium animalis* ssp. *lactis* Strain A.

Inclusion and Exclusion Criteria:

The inclusion criteria for all parts of the study include the following:

1. Written informed consent obtained prior to any screening procedures and in accordance with federal, local, and institutional guidelines.
2. Age ≥18 years.
3. Adequate hepatic function:
    a. total bilirubin ≤2 times the upper limit of normal (ULN) (except patients with Gilbert's syndrome [hereditary indirect hyperbilirubinemia] who must have a total bilirubin of ≤3 times ULN),
    b. aspartate aminotransferase (AST) and alanine aminotransferase (ALT)≤2.5 times ULN (except patients with known liver involvement of their tumor who must have their AST and ALT≤5.0 times ULN).
4. Adequate renal function: estimated creatinine clearance of ≥30 mL/min, calculated using the formula of Cockcroft and Gault (140−Age)·Mass (kg)/(72·creatinine mg/dL); multiply by 0.85 if female.
5. All patients in part B+C must be willing to have fresh biopsies at start of therapy and after 4 weeks of therapy.
6. Contraception: Female patients of child-bearing potential must agree to use dual methods of contraception (including one highly effective and one effective method of contraception) and have a negative serum pregnancy test at Screening, and male patients must use an effective barrier method of contraception if sexually active with a female of child-bearing potential. For both male and female patients, effective methods of contraception must be used throughout the study and for 3 months following the last dose.

For the portions of the study testing relapsed/refactory colorectal cancer, the inclusion criteria also include the following:

7. Histological or cytological documentation of adenocarcinoma of the colon or rectum.
8. Known MSI/MSS status.
9. Measurable disease by RECIST v1.1.
10. Metastatic disease not suitable for upfront curative-intent surgery.
11. Documented evidence of progressive disease according to RECIST v1.1.
12. Prior treatment (with completion of a course of therapy, or to disease progression or intolerability) with each of the following:
    a. Fluoropyrimidine-, oxaliplatin-, irinotecan-based chemotherapies (e.g., FOLFOX and FOLFIRI)
    b. if KRAS wild-type, an anti-EGFR therapy,
    c. Regorafenib or TAS 102 (Past A required, parts B+C optional)
    d. Radiation and surgery are not considered as prior anticancer regimens
13. Patients should not be transfusion dependent.
14. Adequate hematopoietic function: ANC≥1000/mm3, hemoglobin (Hb)≥9.0 g/dL, and platelet count ≥100,000/mm3.
15. Eastern Cooperative Oncology Group (ECOG) performance status of ≤1.
16. Life expectancy of ≥3 months.

The following categories of patient are excluded from the study:

1. Female patients who are pregnant or lactating.
2. Major surgery within 4 weeks before C1D1.
3. Impaired cardiac function or clinically significant cardiac diseases, including any of the following:
   a. Unstable angina or acute myocardial infarction ≤3 months prior to C1D1;
   b. Clinically significant heart disease (e.g., symptomatic congestive heart failure [e.g., >NYHA Class 2]; uncontrolled arrhythmia, or hypertension; history of labile hypertension or poor compliance with an antihypertensive regimen).
4. Uncontrolled active severe systemic infection requiring parenteral antibiotics, antivirals, or antifungals within one week prior to C1D1.
5. Any ongoing antibiotic treatment which has not been discontinued at least 3 days prior to initiation of therapy
6. Patients with known symptomatic brain metastasis are not suitable for enrollment. Patients with asymptomatic, stable, treated brain metastases are eligible for study entry.
7. Patients with a known history of human immunodeficiency virus (HIV); HIV testing is not required as part of this study.
8. Known, active hepatitis A, B, or C infection; or known to be positive for HCV RNA or HBsAg (HBV surface antigen).
9. Prior malignancies:
   a. Patients with adequately resected basal or squamous cell carcinoma of the skin, or adequately resected carcinoma in situ (i.e. cervix) may enroll irrespective of the time of diagnosis.
   b. Prior malignancies which may interfere with the interpretation of the study. Cancer treated with curative intent <5 years previously will not be allowed unless approved by the Sponsor. Cancer treated with curative intent >5 years previously and without evidence of recurrence will be allowed.
10. Patients with active central nervous system (CNS) malignancy. Patients who have only had prophylactic intrathecal or intravenous chemotherapy against CNS disease are eligible.
11. Patients with gastrointestinal tract disease (or uncontrolled vomiting or diarrhea) that could interfere with the absorption of EVP001.
12. Serious psychiatric or medical conditions that, in the opinion of the Investigator, could interfere with treatment, compliance, or the ability to give consent.
13. Patients unwilling to comply with the protocol including required biopsies and sample collections required to measure disease.
14. Radiotherapy within two weeks prior to screening. Patients must have recovered from clinically significant toxicities.

The use of any concomitant medication/therapy, including over-the-counter (OTC) medications deemed necessary for the care of the patient is permitted during the study. Medications required to treat AEs, manage cancer symptoms, concurrent stable diseases and supportive care agents (e.g. blood product transfusions), pain medications, anti-emetics, and anti-diarrheals are allowed. Concurrent therapy with growth factors is allowed. The use of any immunosuppressive agents must be discussed between the Investigator and the Medical Monitor on a case-by-case basis. Any diagnostic, therapeutic, or surgical procedure performed during the study period should be recorded, including the dates, description of the procedure(s), and any clinical findings, if applicable. All antibiotics are contraindicated.

Hormonal contraceptives are permitted in women of child-bearing potential. Hormonal contraceptives include any marketed contraceptive agent that includes an estrogen and/or a progestational agent.

Investigational or commercial anticancer agents other than *Bifidobacterium animalis* ssp. *lactis* Strain A is not allowed during the study. The initiation of any non-protocol specific anti-tumor treatment is considered an indication of disease relapse/progression and should be recorded appropriately in the electronic case report forms.

Palliative radiation therapy to non-target lesions is permitted but study treatment is held for ≥1 day before the start of palliative radiation therapy and ≥1 day following each dose of palliative radiation therapy. Treatment with *Bifidobacterium animalis* ssp. *lactis* Strain A is not discontinued solely due to palliative radiation.

Supportive measures for optimal medical care should be provided to patients during participation in this study. These should be based on institutional and/or National Comprehensive Cancer Network (NCCN) guidelines.

Dose Escalation Study

Patients receive all *Bifidobacterium animalis* ssp. *lactis* Strain A doses during the 7 day treatment period, or have had a dose-limiting toxicity (DLT) within the treatment period to be considered evaluable for dose escalation decisions. *Bifidobacterium animalis* ssp. *lactis* Strain A is orally administered as tablets or enteric coated capsules. Dose escalation decisions occur when the cohort of patients has met these criteria.

A DLT is defined as an adverse event (AE) or abnormal laboratory value that occurs within the first 7 days of treatment with *Bifidobacterium animalis* ssp. *lactis* Strain A, except for those that are clearly and incontrovertibly due to underlying disease, disease progression, or extraneous causes, and meets any of the criteria included in Table 4. National Cancer Institute Common Terminology Criteria for Adverse Events (NCI CTCAE) (Version 4.03) is used for all grading. In addition, >4 missed doses of *Bifidobacterium animalis* ssp. *lactis* Strain A will be considered a DLT. Dose escalation decisions occur when the cohort of patients has met these criteria.

TABLE 4

| Criteria for defining DLT | |
|---|---|
| Toxicity | Any of the following criteria (based on CTCAE [Version 4.03]): |
| Non-Hematologic | Grade ≥ 3 nausea/vomiting, while taking optimal supportive medications. Any other Grade ≥ 3 non-hematological toxicity except alopecia or electrolyte abnormalities correctable with supportive therapy. |
| Hematologic | Grade 4 neutropenia lasting more than 5 days. Febrile neutropenia (absolute neutrophil count [ANC] < 1 × 10$^9$/L, fever > 38.5° C.). Grade 4 thrombocytopenia, or Grade 3 thrombocytopenia with bleeding, or any requirement for platelet transfusion. |

CTCAE Version 4.03 will be used for grading all AEs and laboratory abnormalities. Patients may receive supportive care as per local institutional guidelines.

To implement dose escalation decisions, the available toxicity information (i.e., all AEs and all laboratory abnormalities regardless of DLT assessment) is evaluated by the enrolling Investigators and Sponsor medical monitor at a dose decision meeting or teleconference. Decisions are based on an evaluation of all relevant data available from all dose cohorts evaluated in the ongoing study including safety information, DLTs, all NCI CTCAE, Version 4.03 toxicity data during Cycle 1 from evaluable patients. Drug administration at the next higher dose cohort may not proceed until the Investigator receives written confirmation from Sponsor indicating that the results of the previous dose cohort were evaluated and that it is permissible to proceed to the next higher dose cohort.

Table 5 below describes the starting dose and the dose levels that may be evaluated during the study for all parts of the study.

TABLE 5

Bifidobacterium animalis ssp. lactis Strain A Dose Escalation Levels

| Cohort | Dose Levels QD dosing; 3 week cycles | Number of Patients |
|---|---|---|
| 1 | $2 \times 10^8$ organisms | 3 + 3 |
| 2 | $1 \times 10^9$ organisms | 3 + 3 |
| 3 | $2 \times 10^9$ organisms | 3 + 3 |
| 4 (optional) | $4 \times 10^9$ organisms | 3 |

A standard 3+3 dose escalation is conducted as follows:
If 0 of 3 patients experiences a DLT, escalate to next higher dose cohort.
If 1 of 3 patients experiences a DLT, that cohort will be expanded to 6 patients. If 1 of 6 patients experiences a DLT, escalate to the next higher dose cohort;
If ≥2 of 3 or ≥2 of 6 patients experience a DLT, the maximum tolerated dose (MTD) is exceeded.
If the MTD is exceeded, enrollment of additional patients will be at a lower dose level. If a starting dose does not clear DLT assessment, dose de-escalation will proceed using standard 3+3 rules Intra-patient dose escalations are permitted for all cohorts after the intended dose level has been shown to be safe (i.e., all patients treated at the intended dose level completed DLT assessments and ≤1 patient experienced a DLT).

For dose escalation patients after 7 days and dose expansion patients, if an event meeting the definition of a DLT, but without necessarily occurring within the first 21 days, is observed in >33% of patients at any time, or if >33% of treated patients have withdrawn consent due to toxicity, enrollment will be held and a meeting with all Investigators and Sponsor will take place to review the events and discuss their clinical significance. Based on this review, the Sponsor may elect to reduce the dose for enrolled patients and to resume enrollment of the expansion cohort at this lower dose, or the enrollment into the expansion cohort may be stopped.

Safety and tolerability are evaluated by means of DLTs (dose escalation cohorts only), AE reports, physical examinations, electrocardiograms and laboratory safety evaluations.

Anti-tumor activity are assessed by the Investigator according to disease specific response criteria and described in terms of objective response rate, duration of response, progression-free survival, clinical benefit rate, overall survival, and disease control rate.

In Part A: Peripheral blood WBC subsets and cytokines are analyzed at baseline and 7 days. Cytokines are additionally analyzed at 24 and 48 hours.

In Parts B and C: Peripheral blood WBC subsets and cytokines are analyzed at baseline and 7 and 21 days. Baseline and day 28 tumor biopsies are analyzed for immune subset infiltration, as well as makers of angiogenesis, proliferation, and death.

Patients continue to receive Bifidobacterium animalis ssp. lactis Strain A until the patient has confirmed pharmacodynamics, withdraws consent, is lost to follow-up, experiences intolerable toxicity which precludes further treatment with Bifidobacterium animalis ssp. lactis Strain A, or treatment is discontinued at the discretion of the patient, Investigator, or Sponsor. Patients who have objective disease progression but have evidence of overall clinical benefit may, at the request of the treating physician, continue treatment with Bifidobacterium animalis ssp. lactis Strain A after discussion with the Medical Monitor.

Example 20

Figure 8:
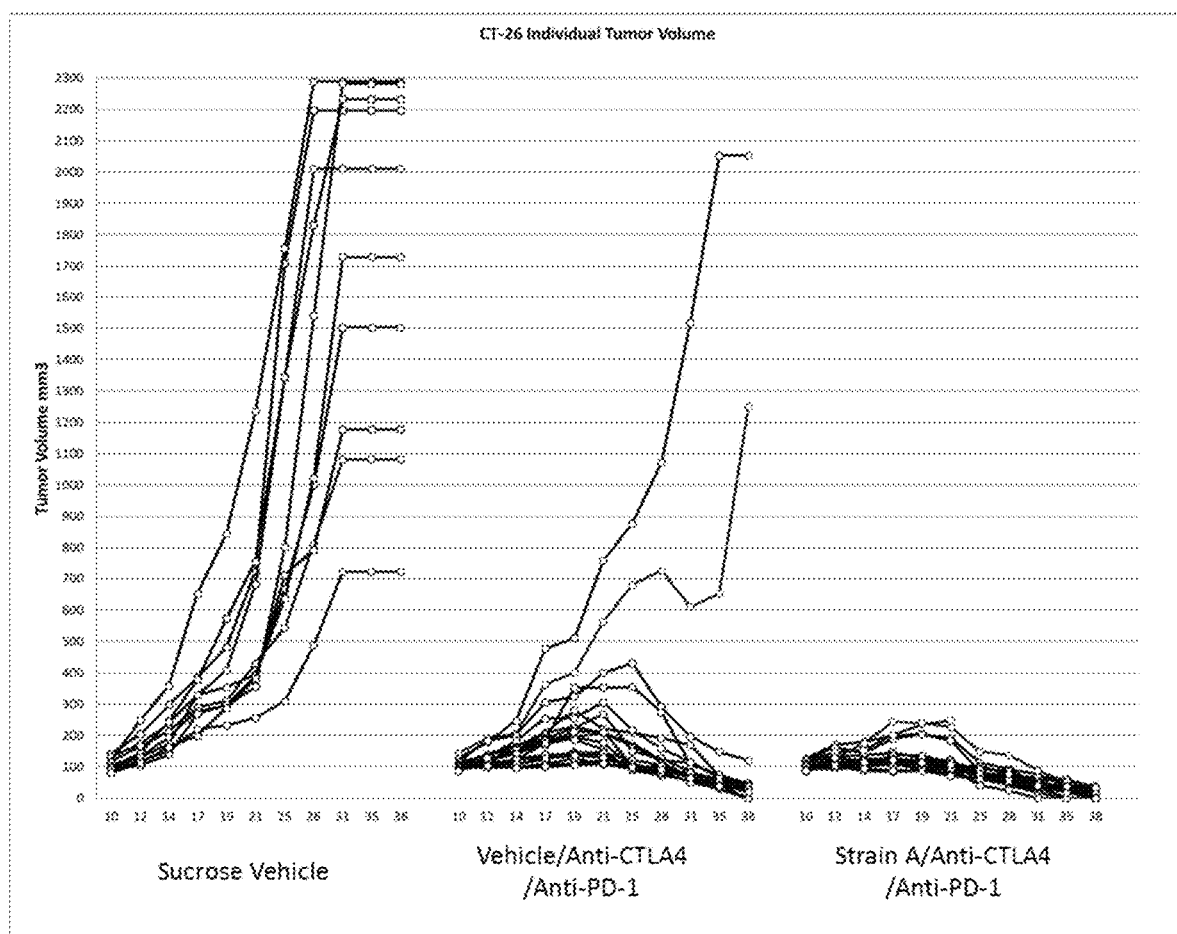
FIG. 8 shows that in a mouse colorectal carcinoma model, the efficacy of a triple combination of *Bifidobacterium animalis* ssp. *lactis* Strain A, anti-PD-1, and anti-CTLA4 is greater than that of the combination of anti-PD-1 and anti-CTLA4.

Intratumorally Administered Bifidobacterium animalis ssp. lactis Inhibits Colorectal Carcinoma Tumor Growth As described in Examples 2 and 3, CT-26 tumor cells were subcutaneously injected into one hind flank of mice and animals were assigned into groups receiving the following treatments: 1) Sucrose Vehicle; 2) anti-PD-1 and anti-CTLA4; and 3) Bifidobacterium animalis ssp. lactis Strain A, anti-PD-1, and anti-CTLA4. $2 \times 10^9$ bacterial cells were administered by oral gavage (p.o.) every day for 21 days. Anti-PD-1 antibodies were administered intraperitoneally (i.p.) at 200 ug/mouse (100 ul final volume) every four days, starting on day 1, six times in total. Anti-CTLA4 antibodies were administered intraperitoneally (i.p.) at 100 ug/mouse (100 ul final volume) every four days, starting on day 1, six times in total. The tumor volumes were measured as described above. The triple combination group of Bifidobacterium animalis ssp. lactis Strain A, anti-PD-1, and anti-CTLA4 showed significant tumor growth inhibition compared to the control group and anti-PD-1 and anti-CTLA4 group (See FIG. 8).

Example 21

Genomic Analysis of Bifidobacterium animalis ssp. lactis Strain A

Over the duration of a CT26 model experiments as described above, tumor volume varied when some stains of Bifidobacterium animalis ssp. lactis were administered. Negative performing microbes were determined through a three-way comparison of tumor volumes at termination of groups treated with microbes, anti-PD1, and vehicle. The distributions of tumor volumes at termination of the anti-PD1 group vs. the vehicle group were used as a benchmark to classify negative performance of microbes. If the distributions were more closely overlaid with vehicle than the group treated with anti-PD1, the strain was considered a negative performing microbe.

For example, tumor volume was found to be higher for groups treated with two species of Bifidobacterium animalis lactis, Strain B and Strain C, compared to the group treated with Strain A.

Figure 9A:
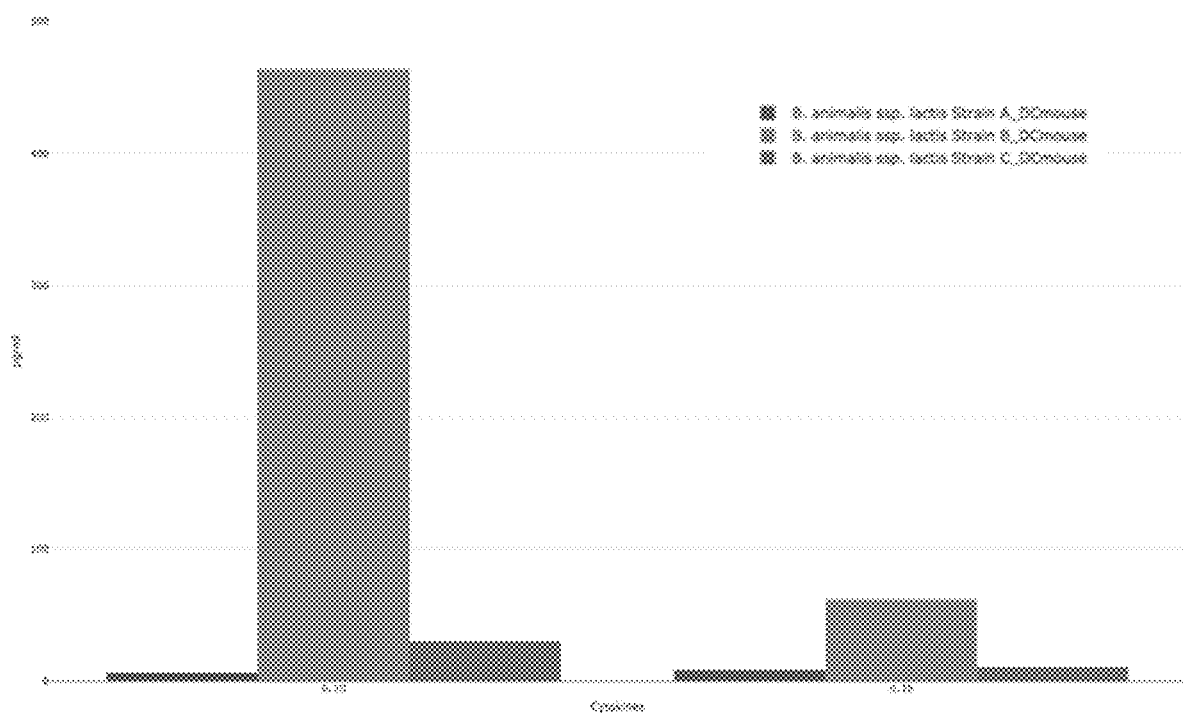
FIG. 9A and FIG. 9B show a comparison of in vitro signatures of three strains of *Bifidobacterium animalis* ssp. *lactis* (Strain A, Strain B, and Strain C) from a mouse dendritic cell assay. Strain A exhibits an immune profile with a decreased induction of pro-tumorigenic cytokines (IL-10, IL-1b, IL-6, IL-8, TNFα) compared to Strain B and Strain C. The cytokine values reported represent geometric mean summary of groups (n=3) across the assay.
Figure 9B:
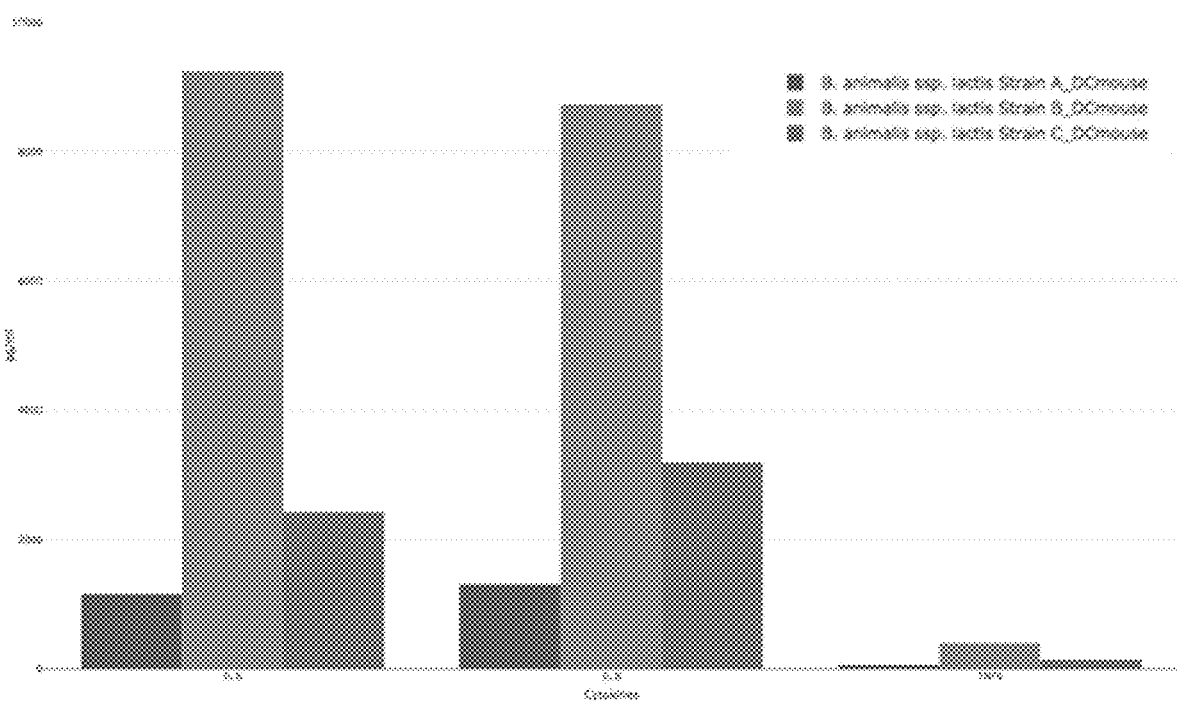

Consistent with these findings, a comparison of in vitro signatures of the three strains from a mouse dendritic cell assay show that Strain A exhibits an immune profile with a decreased induction of pro-tumorigenic cytokines compared to Strain B and Strain C (see FIGS. 9A and 9B). Several of these cytokines have been found to be associated with poorer prognosis in the serum of CRC patients (Mager et al., (2016) Cytokine-Induced Modulation of Colorectal Cancer. Frontiers in Oncology. 6. 96. 10.3389).

To elucidate the differences between the strains, Stains A, B, and C were sequenced to ~500× using Illumina MiSeq. The complete and circular Strain A genome (Table 1) was used as the reference to call single nucleotide polymorphisms (SNPs) between the strains. Coding regions were predicted, and SNPs that occurred in coding regions were recorded, along with the nature of the coding change (synonymous, missense, frameshift, etc.) Using groupings established through results in the CT26 tumor model, SNPs that were present in negative strains (Strains B and C) when compared to the reference Strain A were identified, and structures unique to positive strains (e.g., Strain A) were identified.

When compared to highly homologous non-efficacious strains, Strain A contains single nucleotide polymorphisms (SNPs) and or insertion/deletion events in the following genes listed in Tables 6 and 7.

TABLE 6

SNPs and/or insertion/deletions in Strain A compared to non-efficacious strains

| gene | product | Type of Variant | Position in Gene | Strain A Base change | Strain A Amino Acid change |
|---|---|---|---|---|---|
| glcU | putative glucose uptake protein GlcU | Missense | 301 | C | Arg |
| glcU | putative glucose uptake protein GlcU | Missense | 814 | C | Pro |
| relA | Bifunctional (p)ppGpp synthase/hydrolase RelA | Missense | 251 | G | Gly |
| relA | Bifunctional (p)ppGpp synthase/hydrolase RelA | Missense | 2053 | G | Val |
| metF | 5,10-methylenetetrahydrofolate reductase | Missense | 527 | T | Phe |
| nnr | Bifunctional NAD(P)H-hydrate repair enzyme Nnr | Missense | 574 | C | Pro |
| ykoE_1 | Putative HMP/thiamine permease protein YkoE | Missense | 533 | C | Ala |
| tcrY | putative sensor histidine kinase TcrY | Missense | 300 | G | Gln |
| tcrY | putative sensor histidine kinase TcrY | Missense | 49 | C | Pro |
| dac | D-alanyl-D-alanine carboxypeptidase | Frameshift | 199 | DELETION | His |
| hypothetical protein | hypothetical protein | Missense | 739 | A | Ile |
| hypothetical protein | hypothetical protein | Frameshift | 990 | DELETION | His |
| rdgB | dITP/XTP pyrophosphatase | Missense | 547 | A | Ser |
| hypothetical protein | hypothetical protein | Missense | 290 | C | Ala |
| glnB | Nitrogen regulatory protein P-II | Missense | 161 | A | Asp |
| accC | Biotin carboxylase | Frameshift | 826 | DELETION | — |
| trxB_2 | Thioredoxin reductase | Missense | 926 | T | Val |
| afsK | Serine/threonine-protein kinase AfsK | Missense | 686 | G | Gly |
| nhaK | Sodium, potassium, lithium and rubidium/H(+) antiporter | Missense | 989 | T | Val |
| hypothetical protein | hypothetical protein | Inframe_insertion | 45-77 | INSERTION (GGCGCTCGGC ACCCTGGCGAT TGGCGCGGCAAC) (SEQ ID NO: 2) | — |
| oxc_1 | Oxalyl-CoA decarboxylase | Frameshift | 183-184 | DELETION | — |
| wbgU | UDP-N-acetylglucosamine 4-epimerase | Missense | 7 | G | Val |
| wcaJ | UDP-glucose: undecaprenyl-phosphate glucose-1-phosphate transferase | Missense | 292 | G | Gly |
| hypothetical protein | hypothetical protein | Inframe_Deletion | 126-128 | DELETION | — |
| yciV | 5'-3' exoribonuclease | Missense | 100 | T | Ser |

TABLE 6-continued

SNPs and/or insertion/deletions in Strain A compared to non-efficacious strains

| gene | product | Type of Variant | Position in Gene | Strain A Base change | Strain A Amino Acid change |
|---|---|---|---|---|---|
| aspA | Aspartate ammonia-lyase | Missense | 1355 | C | Ala |
| tcrY | putative sensor histidine kinase TcrY | Missense | 368 | T | Phe |
| tcrY | putative sensor histidine kinase TcrY | Missense | 278 | C | Pro |
| nagC_2 | N-acetylglucosamine repressor | Missense | 457 | G | Ala |

TABLE 7

Genes with synonymous variants

| gene | product | Position in Gene | Strain A Base change | Strain A Amino Acid change |
|---|---|---|---|---|
| hypothetical protein | hypothetical protein | 753 | T | Leu |
| hemN | Oxygen-independent coproporphyrinogen-III oxidase-like protein | 912 | A | Gly |
| hypothetical protein | hypothetical protein | 951 | G | Pro |
| hypothetical protein | hypothetical protein | 1722 | T | Pro |
| cytR_2 | HTH-type transcriptional repressor CytR | 372 | C | Ile |
| egtC | Gamma-glutamyl-hercynylcysteine sulfoxide hydrolase | 135 | C | Ile |
| hypothetical protein | hypothetical protein | 30 | G | Arg |

INCORPORATION BY REFERENCE

All publications patent applications mentioned herein are hereby incorporated by reference in their entirety as if each individual publication or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

LENGTHY TABLES

The patent contains a lengthy table section. A copy of the table is available in electronic form from the USPTO web site (http://seqdata.uspto.gov/?pageRequest=docDetail&DocID=US10576111B2). An electronic copy of the table will also be available from the USPTO upon request and payment of the fee set forth in 37 CFR 1.19(b)(3).

SEQUENCE LISTING (2 sequences)

SEQ ID NO: 1 - DNA, 1944302 bp, Bifidobacterium animalis
caacgatgcctcatccacagcagccaactcaaagacatccttacacactaacctgagaagagccaacaaaggcatcccattgcagcgcatcgcaggcttccacgtcgacggcgacgagcaacgactcgccatgctgcatctgcgcggcgaactgtcgatcgacagcaatatgaaacgcctgctgctgattcgtgcgaacgagcagctggcagggggccgtatcacccgaccgcgtagtctcaatgcggtgccgctcattcccgtacgtatacagtcggggtcggattttgcggattggcctgccggtcagtgcgattactgggcggagcgcataggcaactatgtgctcacccaatccacccgcaaatcgatggagggactcgacgacttccagacgcgacgagcccgcattctgcgcagcccaagctcacgccagttcccgttgacgcgcgtgatcggcgaacttgagaagctgacgccgcagttcctgcaattgcggcagcaccagatcgtcgagctgatcgcacaggcgtggaacatcaatccgggggagctgggatccttggcagagccgcaggggcagtccgatcgcacaggcacatccgcgcatcgcagtcgacgcacgtcgaagcgtgtgacggtgggcgaagtggtgcgcgccggtctgctcacggtgggggaccgattcgtatggaaccgcccacgcaagcacgagatctggcgtatcaccgtcaccgagtctgggttccggggcgaggacggcaccgaatatgcgacgccgacgtccgccgcccgcgccatcggaggttcctcggcgagcctgaacgtatggaagcgggaatccgacggccgtgcattgagcgatatctggaagacctatcgcacctcgatgtgatggtcatggatgtgacggtcatgcgacgtcagccattcgatggcgagcttcgtgcggttcgagatgtgcgtcttcgccagaatgccgctgatgcggttgcgcacggtgccctcgctcaggaacagcttcgccgcaatctcacgattgtcgagctcctcggcgaccagctcgacgatgtcatgctcccggtcggtgagatgcgcgaatctgggatcatccggtaatggggacgcctttggttcctccacattcccggacgcatcgtgcatcggcaggttgcgcagcacgtccgcgcccaacaccacctgcccggccatgaccgcctgcactgctggaatcaccgaagccacgtcctgtttgatgagatagcctttcgtgcccaattcgatggcacggcgaatgtactccgggtcggcgaaagtggtgagcacgagaatgcgctcgctggcttcaaggccgtcggtgcccggcatctgcacgtcgatgagcaacacatccggtttctgacgtgcataggccaccacggcggcggccccgtcatgcgcagtccacacgacctcggcggtgccggtggtcgtgaggatcgtgccgatggacgagcagacaatagggtcatcgtcaacaatcgcgaccttcatcgcatattcctttccgctgttttcgggacggacatgaacacgcgccagccgccgttatggtagccgcaggtggctgtgccatccaatgcgcgcgcccgttcctcgatgtcggcgattccaatgcccatgctcgccacgcggccgcgttccggtacgccgccgttgccctgcacgatcagctgccacaaccccggcaaatcaatcagatgcacgtgggcctcagaagctgcgctatgccggattgtgttcgtcaacgctccgcgaatcacggccgtgaatgcatgtgccacatgggaaggcacggcatcgatggcattggagaggcgaatctcgacatcagattgcttggcggtggccatggcatcctcgaccatcgcccgaaaatcagtgccttcgtctttgagaccatgcacggatttgcgaatcatcgtcatcgcctcgtcgagggtatgaccaagctgcccgaattgatcggcatgcagcgtgtcaccggtgctggtggcaatcacttggtccgcattcgtcagcatgatcgcacgagtgagcagatgtcccacattgtcgtggatctcgcgtgcgatgcgtgtgcgttcggtgagccgcgcatgctgcaggtccgccgacctggcggattcgacatcggcgagacgagcgcgcgaacggcggatacgttcccgttggtcgtctgccaacgattggaagcaccgttgtcttcgttgcgcgagtgcgaatacccagccgccgagaactgcgagggaggtgagcgcacatagaatccaaagggccatcacgagcggcgaggtggctgcggctgacagatcgtgcaatgccggactgtgctgaccggccacgattccgcagaccagtggggggacgcagaccagcatttggaaagacctgcccaacgactgcacccgcaatcccagatcgaagcccacgatcggcatcagcgcgatccattgcggaacaaacaggcagaccatgcagaacatcatggcgagtgcgatccagcatctgaggggagccagacggatcaacgagcagaggatcacgcagaacagcagaccaatgacgaaggtggtatcggtgtcgccgctcagcatcaccgagaacagcacgctgacgacgaacatcagcgcatgagctcccacggagatgatcatgccgttgtctctcccctcctattctgttccattgttcatgacaacagggcgaatgtcatgccgaatggtgacaaatgtcaccattcgtacaaaaacggtgattcctggcaccgtgtcggccgttgcctgttcggcaatatggaggcatgaacacagcagagaacaacgtacagcgcgatgccgcaccagcgatcgaggtgcgcgaactggtgaaacgatatgccgacaagctcgcgctcgactatttgaacatgaacgtgcgcactggggagatttacggattgctggggccgaacggttccggcaagaccaccgcgatcaactgcattctcgggttgctcacctatgattcgggccaaatccgtgcattcggcggcaagatgggccccaccgcctacgacctgaagcgcaggatcggcgtggtgcctcaggacgtggctgtattcaacgagctcaccgtgcaggagaacatcgagtacttctgctcgctgtacgtcgctgacaagatgagacgtgcgcggctggtggacgaagcaatcgaattcgtgggactcgaggattaccgcagattccgcccgcgcaagctctcaggaggtctgccgcgccgattgaacattgcatgcggcatagtgcaccaacccgaacccatcttcttcgacgagccgacggtggcggtggatccgcaaagccgcaactcgattctcgaaggcatcaaacggctcaacgagcgtggcgcgaccgtcgtgtacacgagccattacatggaggaggtcgagcagatctgcgaccgcatccagatcatagatcacggccgtcagatcgccatcggcacggccgacgagctcaagcgcatgatcgaggccggcgagcgaatcaccgtcgaagcgccggcgttgagcgcgaatgaggccctgtgccaacgggccgtctcgatgttgggtgacttggaggctgtgcacgaggtgacgttcgagaacgacgagctcgtggtggtctgttcgcagggcgagcacaatctcatcgatgtgctgcaggtgctgcgctcgctcgacatccccatggggcatgtgagctcccgtgcgccgacgttgaacgacgtgttcctcgccctcaccgggaccgacctgcgcgattgagcgtgcggcacatacgacgaaggaggtgaatacatgtggagtacattcctcaacaccatgcgcgtgaatctgcgtgagaagagttcggtgttctggctcttctgcttcccgatcattctgtcgacgatgttcatgggcatgttcggcaacatcggcgaggtctatgaaatacatacgatgaggttcgcagtggtcgcggacgcgaacttctgcagggcgaccaacgcgcgtcagatgctgcatgcgatgcagcggaatccactgcggaacgagggctgcgggaacgccatggaaggcgctgcgcccgatacggcgtccgggcaggtgggttccgagctcaggaacctgttggaattgcaggccgtgtcaaacgtcaaggaggccaagggcctcatcaacgccgaccacggggtgcgtggctacatcaacgccacggaagacgggctgctgaacctgacgatcagtcgtgccagcgtcgcatccgtcaacgatgacaccggaaattccggcttcagtgcatccctcaacattctgcatggtgccgtaggcatgttcaataggcgagccatcaccgtgaccgagctgctcaacaccgattcgggcgtgttccgtgatgccacgttcaccaaggagatgggcgacaccccgacgttcacgaaagttgtgagccccacccatttcaagccgaccgaatccgtccgattctactatgcgctgctcgccatgaccgcactcatgtcgatgaccttcgccaccacgaccgtgtgcgccacgcaggcgaatctttcggcgcttggtatgagacggtcgctggccccgctctccaagttcaaccagctcatgggaggtttcctcgccagctggctatgcgcatcggtgtcgatggtggttgcgacgctctacgtccatttcgtgtgcaaggtcgatttcggcggccgttggcccgtgctcgtcctggcgctgctgctcgcgtcccttaccgccaatgcgctcggcacgctcataggatcgttgccgaagctcacttccggcgtgaaaataggcatcaccaccgcgctgtcgtgcgtgctctcgatattcagtggactctacggcaccggcgcaatgaacctgagcgactggacccaacgcaacgcccccggattcgccatcgtcaatcccacccagcagatcacgaacctgttctacgacttgctccactacgattcctacgccccgtccctacgcacgtcgggcattctcctcgcaatgaccgtgctcgctctgacactgtccacgatcttcctcaggaggcaacgctatgagcacctttagaacatgctggcgagtcctgttcgcccaacgaaccatgatcctcgtctacatcgtctacctgagcctcatgatgttcgggctgtcctggagcatcatccagaacctttcgaacaccgacaactccaccacctatgagacgctgcgacccgaagtggcggtggtcgaccggaatgggggcgtcggctcagggttctcggattcgctgaggaaattcctgtccaaggactgcgacctcgtcgatgtgggcaccacctcccaggacctgcagaccgctgcggcctcaaactatgccgacctcatcgtcatcattcccgaacactatgtcgatgacctggctgcggcattcacctcggattccgccgtccccgagctgcagatggtcaccagcttcaccggagcctacggctccctcgccaaactgcaggtggaggatttcctgaacctcacccggatgactgcgcttgcagatgcagcgtcgtcgggttcctccgttagcgtcgcctcattgaatgcggcggccggttcggtgatcgcggatcttaccggcaatgccgacgcctacccgcagatcgccatcgccgaggacccggcagggaccgacgaccgggaggcgaacggacggtacgcgttccagacgatgatggacatgggagcctatccgatggtcgcggcaatgttcacgatcaccgcaatgacgatgggatcgttctcgggggcaagggtacgcagacgcatgtatgcctcaccgcaacgcaccggttcgatgctgttccagcagttcgcctgttgtggcttgttcggtgtgctcgtgagcctgttctatctggcgctcgccctggctcttccggtggcggccggcttgccgatcaccggcgtcgacccgaggggattcctactgtgcgcattgacgatggtcgcctatagtctcacggccgcggccagtggcttcatggtgagcatgatcgccgtcaacagtgcggcaatcaacgcgatcgccaatgtgtatggtctggtcatcatgttcacctcgggcatggcgttcccggtggatctgatgcccaaggtgatgatcgtcataggcaaatgcaccccgggttggtggttctgccggtcgatcagcgccgcgatgaattccgaaggcaccgtgagcgtatccaactggttcccgggtattgcgttggtgcttctgttcggcgtggcgttcatcgcattgggactcgccttgtcgcagatgcgccgtctgcgcccgaatcttgcggctccggcctcgacccaattggccgaggtctagcgaaacaggcgagggcatatctgaggggcagaggcgcttcgtcaaggtgtctgcgcgctacgcgcgtagcacgctcctcagcgccgctgcccctcagatatgccctcgcctgaaccggagcgtgtcaggcgacgtacatcgccgcagggtaggagagatggttgatctcaggcagttggtcgaccgtcacatagcctgccggcgcattgagcacattggggatgcggttgaccatcgtggcgcaggtgtgctccacagtcgctggtttgaccacatggaattcggtgtcgggttcgccttcgattctccaatcgcacatatcgccgtcgtccggcccatacaccttgccgatgcatgaggtctcgatggtgagtccctgcatcgtctcggtcgtgacgaccgccgacatgccgatgcacacccccgccggaatcgtctcgcccatcgtctccgaatacacatcgacatcgctgaagtaaggcaccgcacgctgcgtctgcgacttgatcgtcagtccgagcctctgcaccagcgattcattggagttccacacgtatgacggcaccacctcgtcgggatgcgccagctgctcctcgaactgctcggccgtaagacccacgccgtgcgctttggcaagcgccaggccgtaatcctcgacattgtagctggtggcgccgctgatcttcgtcatcgaattgcacccgcctgccacctgggccaccatgttgatccagaagatgtcctgcatccccgagccgaccatggtggcgccgttctccttggcgatgcggtcgaggcggttggtcacggccggattcgtcgtccacgggtagatcgcctcctcgcaggtggtgatcacgctgatgccgcgggagagacatgcctcgcacatcggttcgatgtcgtccatgaagctgaacagcgtgacgaccgcaatgtccgcatcgcatgagtcgagcacggcgtcggcgtcatcgctgatcgtcacgttgagcggtccgattccggcgaactcgccgacatccatgcccaccacgtcggggttcacatcgatggcacccacaatctgcatgcctttgtcatgcatgtacctgacggtgtacttggccatcttgccgcagccgaattggattgcgcgaataggttccataaccactcctttgcttgacggccatcacgcctcgttgcgtgtgcgggccgtgcctcccactatagcggacgaaaccccgccggcgtccggcttcgcggaacctccataatcggcaggccgtctgcggaatacctgcgttccatggctgttgcctacaatgagtgaagatgcatatgctcccagccggctttcagcctcctctgggggtattccctgcacgaacagcctatactgttagcacatacgacagaaggaacgaacatgacttatgggcagcagcctatgaacggctcgccatatggccagcaaccatatgggcagcaaccgatgaactatgccaacacgatcaatgttcaggcctcgcagtcatacgagcgcgccgagcatgtctcggtgacgcgcgcatacggcgagatgtgcctgggcctgctcgtcaccgccgccatggcgatcttcacgcagatgagcggcttctacatgcgcttcctgcaggctacgggcggcatgggcatgtggatcctcgccatcgtcgagatcggtctggccatatatctgggcatgcgcgtgatgaagatgtccaccacggccgcccgcgtgtgcttctacgtgtatgcggcgctgatgggcgtcacgctgagcaccatcttcctggcctacgatctgggcaccatcggcatcgcattcctggtgagcgccggcttctacttcgcactcaccatgttcggtctgaccacgaagggcaacatgctcaaggcgggtccgatcctcatgatcgcactggtcgtgctcatcatcgccgaggtgatcatgatgttcgtggcgccgagcaacacgatgctcaaggtggtcaccgcaatcggcatcctgctgttcgcaggactgacgatctatgacgcgcagttcacgaagaaggcgttcgccgtctatgcctcgcagggaccggaggcaatcaagaagatctccatcctgtgcgcgctgaacctgtacctcgacttcatcaacctgttcctgtacattctgcaggcgcttggattgagccgcgattagaaccgacaggttccgtccgggcactcccaacagatggggcgaccgtggaaacacggtcgccccatctgttttccgctgcggaagctcactgccccttgagcgtcgcattgcgaatcggggagtcctcattcgcggtcggtgcctcgccaccctgcggtgcgccgttgatgtcgcgatgaatcgtctgcatctgcgtctccacgttctgcaatgcacgcgcgcagtccagcagcgtctgtgaatgctcggcgtgcttgtcgtcgggcagatcggtcttgtagcgcagcgcatgctccagactcgcccagtagtccatcgcgatcgtgcggaactgcacttcgaccggcgtgtaatgcgcgccgctcgacaggaacaccggcaccgcatagatcacatgcagcgagcggtagccgttctgcttggggttgcgtatgtaatccttcacgcgcagcacctgaatgtccgattgcgccgagaggtaattcgccaccgaatacacgtcgtcccggtaattgcagatcacgcgtatgccagcgacgtcgaacaggttgtcacgaatcgcctccaccgtatagggaaggccacgtcggtcgagtttgcccagaatagattcggttgatttcaatctgcgttcgaggtggtggattggattatgagagaactgcacctgaaattcggagtcgagaatctcgagtttcgtgctgatctcgtacatcgcaccttcgtagatctgcatctggttgatgaaatcggtaatcaggtcgacgccccgttccccctcctcggtgccgtccaatccgagcgaatgcccggccgccgtcaggcgggcgcggatctccgcggtgttcatccgtttctgtctgtcgagtatcacattgccattgtagaaaacgagagcgaacaacgcgtgcggaatccacgtccgggcgacccactgtgccgagcttcggttagcatggcctctatgaacgaagacatgatgacgcctgaggaacgccgcacgaacatatcgcaagcacagcatacgacgcaggtcgagcccggcgccccgcagtacgggggagcatccggccgtggtcgcggtctgtattatgtgcacacgcttggctgccagatgaacgtgcacgattccgagcgcatcgcgggcgtgatggaggagaacggctaccgcccggcgagcgaggagcagttcctggcgcacgatgtcgacgtcgtgatcatgaacacgtgcgcggtgcgagagaatgccacagaacgcatgtatggcaccatcggcaaatggaagcgtttcaaatacaggaacccgcatgcccagatcgccatcggcggctgcatggcgcaactcgaccgcgaacgcatcgccaaacgtacgccatgggtggatgccgtgttcggcacgaagaacatagaggaccttcccgcattgctcgatcaggcccgtgcagcgcaacacacacaggtgaaggtgaacgaggatctcacgctcttcccgagccagctgcccgcacaccgcgcctccgcccattccgcatgggtggccatctcgatggggtgcaacaacacgtgcaccttctgcatcgtgcccaccacccgtggcaaggagcgcgaccgcagaccgggcgacgtactcgccgagatccgcgagacggtgacgaacggggcgaaggagatcacgctgctggggcagaatgtgaactcgtatggctatggcataggcgaccgctatgcgttctccaagctgctgcgcgcctgtggcgagatcgagggactggagcgcgtgcggttcacctcgccccacccggcggcattcaccgacgacgtgatcgccgcgatggccgagacccccaatgtgatgcatcagctgcatttcccgctgcaatccggatccgaccgcatcttgcgcgccatgcgccgctcataccgttccgagaggttcctgggcattctcgcgaagattcgtgaggcgatgccggatgcacagatctccaccgacatcatcgtcggcttcccgggcgagacggaggaggatttccagcagaccctgcgcgtggttgaggaagccagattctcgtcggccttcacgttcatctattcgccgcggcccggcacgcccgcagccgcaatggaacaggtgccctatgacgtggccctcgacaggctcgaacgtctgctcgccgtgcaggagcgcattaccgaggagattctcgagaagttcgtgggccgtgacgtcgaggtgatgatcaccggtgtgaccgggaagaaggatgccgagacgcaccgctacaccggtcgcgagaaaaccggcgtgctggtgcatgtgggggtgcccgaagggcatgatgcaccgcagatcggtgatttcgtcactgccaccgtcacccatgctggccgtcataacctgattgcagaccccgatctcgccaaaggacagacctatgccatccgcaggagttgagcgccatgacggcgcgcgtgtgatctcgatcgtcggccccaccgcctctgggaaaactggcctgggcatcgcgatcgcccggagactcgccgatcgtggtgaacgtgccgagatagtgaatgccgacgcctaccagatgtaccgcggcatggatatcggcaccgcgaaggcgagcgacgaggaacgtgcggcggtcaggcatcatctgctcgacgtgattgagccgagcgagacgatgtctgtcgcgaggttccaacagatggcgcgtgaaaccatcgccgatctcaagtcgcgtggcatacggccgattctggtcggtggctccggcctgtacgcccgtgcggccatcgacgacatctccttcccgggcaccgacccgcagattcgggagcatctggaggagcgtgagcgaaccgagggagccacggcattgttccgcgagttggcggtcaaggatccgcaggcggccgagcatatggatccgcgcaatccccgtcgcatcattcgcgcactcgaagtgatcgaggtgaccggcaaaccgtattcggccacgttgccccggtaccgttatgtgattccgtcggtgcaattggggctcgaccttgaccgtgccgatctggacaagcgcattgacgtgcgcacgaggcagatgttcgacgggggcttcgtggatgaggtggcgcgtctgcgttcccatctggggccaaccgcagcccgtgcgctcggctaccagcaggtgatcgaccatctcgatggtctggtcgatttggacgacaccatggcagacatcgcgcagaagaccaagcgcctcgcccgcaagcaaatgggatggttcggccgagacccacgcatccactggctctcggcattgaacccggctctggtcgacaatgcgatggcggtcatcgaccacgccgacgccggcgactacgatgccatcgacatgcatgcacaggaatatgtgcagcatcatctgggcgatattcgccggccgtctggtgcgggaccggtctgaggtagaattcaaccgttatggcacaatcatcttccaaatcatcgaagggcaggaccgcccgttcctcctccggcggcgggacggggtcacgtgcaggttccgcgcagagttcacagggtggtgcgcggaaccaaggagcggaaccgttctggcacaaggcattgctatgtgtgccacgggcgttcggctctgccgtgcgtaaggtgagcgtgggggagtacgacccggcgtatcgtcgggatggattgtgcttcgtcatgatcatcctcgccgtgttcttctgcgggtccgaatggttccgcgtcgacggagcgctcggacgcgggctgcactcgttcgcctccgcgatcttcggtgtgatgagcgtggtggtgccggtgctgctcatcgtgttggcgattcgcctcatgcgcaactccggcaagcaatcccacaacacgcaggtgattgccggtggagtgatgttgctgtggtcgatctgctcgatcatcgacgtgatcatggctgcggacacgaaggagttctcctggcagaacattcagcaggccggcggtctggtcggtttcgtcgtcggatcacctctggcatgggggctctcccagacgttcgcaatcatcgtgttcgtcgtggctgcggtgttctccgtgctgttgatgacgcgcacccatgtgaccgagattccgcagaagctgagtagattctcccggcggggatctgctgattccgcggatgcgcagcagtcggatcccgaggtcgggcagttcctgaacgaggtgcgcgtgggcgacgatacattggcgttcgcggatggcgtgcctgcgcatgacggcactgacgtgccggaaccggacagcaaggtcggcttcctcgccaggctgttccatcgacgcgggaagggccccggcaccgacacgaaactcgatcgctatgcaggtgacgaggcgttcctcaacgccgcgagccgccatggggatgccaacgaaacggatctgcacgagggcccgcgcagggtgagcagtggcggtgccttcaatgacgacgccacgcgaagcatcgactcgggcacatggaacgcccagccttcaggcaccattccgctgccatccggctccatgcccgcagcgacggccaccggcaccgatccctgggcgcatctcgatgcggagggcgagacgatggtggtctccacccagaccggcgagatcctcgaccggtcgccggcctcgtcgcccatgccgccaaccggctccaggataccgccggccatgccatcccccgcgacgcctgaagaccatgaaggcatgcctgacattccgcaacagcctgatgcgccataccatctgccggatctgaacctgctcgtcaagggcaaaccgcatgccgcgcacactcaggcgaacgacacggtgatccatgcgctgaatgagacgttccgccagttcaaggtggatgcgaaggtggtgggattcctgcgaggcccctcggtcacgcagtatgaggtggaggtggcaccgggagtcaaggtggagaaggtgacgaacctcgacaagaacatcgcctacgctgtggccagttcggatgtgcgcatcctctcgccaattccaggcaagagcgcgatcggcatcgagattccgaacgccgaccgtgagatcgtgcatctgggtgatgtgttgcgctccgacaaggcgatgaacgaccccaatcctatgctcaccggtgtgggcaaggacgtcgaggggcatttcgtgactgccgacctcacgaagatgccgcatttgctggtggcaggtgcgacgggttccggcaagtcgagcttcatcaactcgatgctcacgtcgatcatcatgcgcgccacgcccgatcaggtgcgtatgatcatggtcgatccgaagcgcgtggaactctccgcatatgcgggtattccccacttgatcacaccgatcatcactgatccgaagaaggcggcccaggcattggaatgggtggtcaaggagatggacgcccgatacagcgatctggagttcttcggcttccgtgacgtgaaggatttcaacaaggcggtgcgtgccggcaaggtccatgcgccggcggggtcgaaccgcaaggtggccccttatccgtcgctgctcgtggtcgtcgacgagatggccgacctcatgatggtggccaagaacgacgtggagagctcgatccaacgcatcacacagctggcgcgtgcggcgggcgtgcatctggtgctcgccacccaacgcccttccgtcgatgtgatcaccggcctgatcaaggcgaacattccgtcacgtctggcttttgcgacttcctcggccaccgattcgagggtcattctcgacaccaccggcgccgagacgctcatcggtcagggcgacgcgctttttctgcccatgggctcggccaagccgattcgtgtgcagggcgcctgggtgaacgagtctgagatccgcaaggccgtcgagttcgtgcgcacgcaacgtaagccgcactaccgcgaggacatcgagcagatggccaaggaagcggaccagaagaaggtcgatcccaccgaggacattggcggtgatatggacgaactgctgcaggccgccgaactcgtggtcagttcgcagttcggttccacctccatgctgcagcgcaaactgcgcgtcggcttcgcaaaggccggtcgactcatggatctgcttgaatcgcgtggggtggtggggccgtccgaaggttcgaaggcccgtgaggtgctggtgcagcctcaggatctgccgcaggtgcttgcgttcatcaagggggagagcggcagcctgaccggtgccagagccccggctgaaccgacctctggcgcctccggcactgccgagtactgatgtacttggtgctgggcgtgcccggcggcatgccggtgtgaatgtttctcgggatatggtgcaggttgtccgacacggcaacgctatggacatgtaagcgagtacgctagccactatggagactgagaaatcaaccaagcaatcgatgtggagccagtggagttcaccgccgaacctggtgacgctcgcccgaatcgtactcgttgtcgtgttcctgggactctacatcggcggtggtgcatggggtgcccgcaacatcggcatgcggtggggcgccgccatcgtgttcatcatcgccgcgtcgaccgataagatcgatggttggatggcacgcaaatacaatcaggtgacggaactgggcaagctccttgatccgatcgccgacaagctgctcacgcttggtgcgctcgtcgtggccgcctgtttcaacgaatttggcaacatgtggattggctggatcgtcaccggactctacgtggtgcgtgagatcggcatcacgatcatgcggttcttcgtcatcgaccacggcggcaaggtgatcgcggcgtcgcaggcgggcaaatacaagacattcacgctctgcctgggtctcggattgctgctgatcccggtgtggagcttcacgcatgccgtgtcgcagccggcgtggttgaccgtgtacttcattgtcgcgtatgcgctcatctacttctcgctcattctgtgcctgtattccggttacgagtatctgcgaggcgtgttcgcgaaacctgcggtgacgcgcaaataggcgaatatctgaccaacggtcgcaacgatcgcatacgggcccgcgtacttcggtgtgcgggcccgttgctttgccgttgcatatgcaaaacatgcagacaacacgccgttattcacaatgtctgcacaatttttcacactgagagtgaacggcatgcagatgacgacgtggagggagcaggtgtggcagaacttttcgaggtcgccgaactcgccggtgtgaccgacgtggccgatgtacagcggtattgcgacgaacaggcgcgccatattcttgctcactgcgacgtccggggactcaagattgcatgcgcagagtccctcaccgctggtctgctcgcggattcctttgtgcggattccgggggcgtcgagcgtgttcctcggttctgcggtgacgtatgacattcacgccaaggcgatggtgttgggcgtcgatgcggaactcttacggacccatggcgcggtcgacccggaagtcgcgcggcagatggcccgcggggccgcccatctgttttaccaagagcaatatgcgcatggagtcgtggggttgtctaccactggtgtcgcagggcccggacccgacgagggaaaaccggcaggaaccgtgtatatcggcttcgatgtgccgtgtttttctcatagcgtaatacaggaacgtgattttgcgctcagattagcgttacgcggctcgcgagaactggttagacatctcaccgtggcctgtgttctgggaaaaatgagagaattcacaggttcttcacaggaaaaaattccgataatggagacaagggaaactcatgaggggtagtaggaaaggaaaggtgttcgtgatggaacagatgacaatggttaacgagcaagttgaagtcaagtcggttgagactccggagcaggtgcgctcaggcagtgcacgcatgcgcgaactcactccggcccagcgtcgtgcggtgatgttcgcccagcagcaggttcttcgtgcccgtgccgcaaagaaggccaaggacgagcatcaggccgccctcgcacgcatgtggcaggaggaagacgccgagaccgcgcgtccgcgcgcgatggtgcaccgtcgtgagaccgtgggcgaggtgaaggaagtgtccctgcgcaaggcgatcgggcatgtactgcgcgaccttcgtacacgcgatcacaagacgttgcgtgaggtgagcgagaaggcgggcgtgtccctcggctacctctccgaagtcgagcgtggccagaaggaggccagctccgagctgctggcgtccatctcggaatcgctgggtctgagcacatcgcagatgctgcgcatggtcgcggattacctcgattccgtcgaggcgtgaattcgggcgttcgcctatgaatgtcggcccgctgctttggtggcgggcctttttcgtgtctatgcgccgcatctgatatatcgaagctgggttggtcggctcctcttgcggcgctgtgccgacgcggttatgcttggggccatgcgtgaacgggaattctggcagttgctcgaagaagtgttcggtcgctcctatggcagggcgttggcccatgaccaggggctcaccaagttgcatggcatgacggtggtggaggcgctggccgccggcgaagagcctcgtgtggtgtggaatgtgttgtgcggccagatggatgtgcccgatgcgaagcgttggggccgggatcacaatgcaccgccgctgcccgtcgattttcactaggggtgcttgggtggtctggcggggcgtgttgagaatgtggagaaccagtcggcagatgggcgtattcgaacaaatgttcgcatgagagggtatactgagcatatcgcaaaagccacggcgtcgattgcatgcgtatgctgcatatgatgtgtggatatcggtgtcctccgaccacaaggccccggcgcgcttgtgccgcccgacactgtgccggtagggttggggtgttcgccgatcatggcgcgtttgactgttgaagtgaggagtacagatggctgcacgaagcaagtcctccgtcaaggagacggagaagaccgaggcgcctggcgtcgacaagaagcgcgaggatgcgctcaattcggcgttggcccaagtggagaagcagttcggcaagggctctgccatgcgtttgggagataggccggaacaggacatcgaggtgattcccaccggttcgttggccctcgacactgctttgggcatcggcggtctgccccgtggacgcattgtggagatctatggcccggagtcgtcgggcaagaccacgctggcgttgcatgtggtcgccaacgcgcagaagaacggtggcgtggccgcgttcatcgacgccgagcacgcccttgatcccgtgtatgcgcgccacctgggcgtcgataccgattcgctcatcgtttcgcagccggacaacggggagcaggcgctggaaatcgccgacatgctcattcgttccggggctcttgacgtcatcgtcatcgattcggtggcggcgttggtgccgaaggccgagatcgaaggcgatatgggtgacagccacgtcggtctgcaggcaaggctcatgagccaggcgctgcgcaagatgaccggtgcgctggcacaggcgaacacgacggccatcttcatcaaccagttgcgagagaagatcggcgtattcttcggaagcccggagacgaccaccggcggcaaggcgttgaagttctatgcatccgtccgcatggacatccgccgcatccagacgctgaaagacaaggacgagccgattggcaaccgcactcgtgtcaaggtggtcaagaacaagatggcacctccattcaagaccgccgagttcgacatgctctatgggcagggcatctcgcaggaagggtcgattctcgacatggcgttggagaccgacgtggtgaggaagtccggttcttggttcacctacaacggtgaacagctggggcagggccgtgagaacgtgcgtaagttcctcatcgacaatccgaagctcgccgaggagatctccactcaggtgaaggtcaagaccgggctcatctccaccgacgaccagttcggcgtcgacggcaccgaggaggagaacggtgagtctataaccaccagtgagtcgaatgcggaggctcagacgagtgctgaagcctgagtgcttctttgggtgccccgtggatcgggtgtcggccggccgacgctcgatccagggggcaccggcgtattgcatgccgtaccgaaggaatgcggagaatggagttgcaatgatcagtgcagaggagtttctgagctcccatgagcagatggtgcgtgagccgtcggcgcccaacagctcaaatcgagacgttccggggaagcacccgacgaaggaacggcgtcgaaagctgtctggtggcttcgcctattcggtggcggcggattcgcacgacgaagatgagtgcaaggaaagcgcattgcgtctgctcgacgcggccgcgcggtccagcggatccctgcgggacaagctcgtcgaacgggaatacgatgccgaggtgatcgaccgcgtcgtcgcgcgtctcgaggagcttggactcattgacgatgaggaatacgcccgcaatgtgattcgttcctgcaccgcccgcatgatgggtgcgcgtggtgtcatacgggagctggtgcgcaagggggttcctcgccctctggccgaacgcatggtacgggagaccgcacaggccggggtattcgaagactgcgcgtgggaactcggcaggactgtggcgaaaaagaacgccggtaaagatgtcgaggtctgcaaacggcgcttctggtccgccggaggccgtaagggccatgcgccggaggatctgcgcgccgtaagcgacgagttgtttcgacgtcggatctacgaatgacggtcaaatcaatcatgccgaaaagaccgaaagataaggagtgagacctcttataccccgggttctgtcatgccgtgaaggcatggatggccatccatctcgacctgacgtcgccgtcaggctctagcagcctacccgaaggcagagcgagcaactctatagccttctgcttggccttgctcccgatgaggcttgccatgcggctcctgttaccagttgcccggtggtctcttgcaccgccgtttcacccttaccggcccgaaggcaggcggtctgttctctgctgcgctatctctcaggtcaccctgggcggacgttatccgccatcgtgctctgtggagcccggaagttcctcagccacaaagtggccgcggccatcaagaggtctcgcgtccgattgtagcaaggggtgtgactgcctgcagtggtggctggaggaggcgccttgtgacgaaactggtgctttggtgcggcatatgcatctgcgacgcgagcaatccgttccgactcgtgggaaaagacgccgttttttcaacaaataggggagagcgggggcgtgtcttgccaattcttgcccgaactcgattacaatatgagtcatatccgaatggcagtagccgttcggtccgtatatagcggtgtgaaagccgcttgagtctagggaggtccacatggatatcgttctgacaggccgtcacattcagatcaagcagaagttccgtgacgtcgtcgaaagcaagatgaatcgtgtgaccacaattgcgccggacgcgcagcgcgtacaggtcgtgctgtcgcatgaaggcaatccacgtctgcatgacaccgccgtccgcgtggaactgaccgttgtggctggttcgaccgtggttcgcgccgaggcgtccagcctcgatgaggtgagtgccctcgatctggcgctcgacaagctcacgctgcgtctgcgccgtgcgcgcgatcgccgcaaggatcaccgcaagaactacacgccggtgccggtcgatgcgggcaagttcgtgccgccgagcgaggagcgcgaagacatcatgggtgacgaggacgtcgacaacagccccgcctccgcagtcgccggagatctcggtccgggcgagtccgtcgaggttcacgtcggcgacaccccgattgtcatccgtcgcaagctgcatgtcgcagaacccatgagcatcgatgaggcgctgtatgagatggagctcatcggccacgacttcttcctgttcgtgaacaaggacaccggccgtccgtcggtcgtctaccaccgtcacggctggagctacggcgtcttcgagatcgacacccccgagaacatcaagaagctcgaagaggagcgcaaggcctgaacaggtttcgtcctcaatggaaagcggctcgcgttgcgggccgcttttgctttgtcggaaaaggggcggcattcacacatttgtgtgcggaatgcgaaggaatgccaaaaatgcgcaaatcttcgtagaatagccgaaaaaagtggaatagggggctcgagccgcttattgtaggagtgttgttgcaaacaccgttagggagtaaatgtggttgatatcgtagacaaagccctgcgtatgggtgaaggtcgccagatcaagaagctcgaacacgtcgccgaagccgtgaacaagctcgaagatcagatggtggtcatgagcgatgacgagctcaaagggcagaccgccaagttcaaggaacgcctggccaacggcgagacgctcgacgacctgatgccggaggctttcgcgacggtgcgagaggtgtccaagcgcacgctgggtcagcgtcacttcgacgtgcagcttatgggtggcgcggcactgcactggggcaacatcgccgagatgaagaccggtgaaggcaagaccctcgtggcgacgttgccgagctacctcaacgcgctcgaaggcaagggcgtgcacgtcatcaccgtcaacgactatctcgccagctaccagagcgagctgatgggccgcatctaccgtttcctcggcatgagcgtcgggtgcatcgtcaccggccagaagccggccgaacgtcgcaagcagtacaatgccgacatcacctacggcacgaacaacgaattcggtttcgattacctgcgcgacaacatggcgtgggagaagaacgagctcgtgcagcgtggccaccattacgccatcgtcgacgaggtcgactcgatcctcatcgacgaagcccgtacgccgctcatcatttccggacctgccgagggtgatgtgacccgttggtaccgtcagttcgccaagctggtgctcaagctcaaccgtgacgaggactacgaggtcgacgagaagaagaagaccgtgggcattctcgacccaggcatcacgaagatcgaggactacctgggcatcgacaacctgtatgagccgagcaacaccgcgctgatcggctacctcaacaatgcgatcaaggccaaggagctgttcctgcgcgaccgcgactacgtggtcaccggcggcgaggtgctcatcgtcgacgagcacaccggacgtattctgcccggccgccgttacaacgagggtctgcaccaggccatcgaggcgaaggagaacgtggaggtcaaggccgagaaccagacctttgccacgatcacgctgcagaactacttccgcatgtacgacaagcttgcgggtatgaccggtacggccgagaccgaggccgcggagttcatgggcacctacaaactcggcgtgctgccgattccgccgaacaagccgatgatccgcatcgatcaggacgacctcatcttccgtacgaagaaggagaagctcgccgcgatcgtcaaggatgtggctgcgcgtcatcgcaaaggccagccggtgctgctcggcaccgcctcggtggagtcctccgaagtcgtctcctcgctgcttgacgtggttgagatcccgcacaaggtactcaacgcgaagcagcatgagaaggaggcggcggtcgtggctgtggcgggtcgcaagggcgccgtcaccgtcgccacgaacatggccggtcgaggcaccgacatcatgctcggcggcaacgtcgagttcctcgccgacgccgaactcaaggcgaagggctactcgccggacgacaccccggaggaatatgaaaagctgtggcctgagaccctgaagaagatcaaggagcaggtcaaggacgagcacgaagaggtcaagaagctcggtggcctgtatgtgctcggtaccgaacgccacgaatcacgccgaatcgacaaccagctgcgcggccgctccggacgtcagggcgatccgggtgagtcccggttctacctgagcctcgaagacgacctcatgcgcctgttcaacacgcagctcgtcgcccgtgtgatggcgaagggcatgcccgagggtgagccgatcgagtcgaagagcgtgtccaagggcgtgcgcaatgcgcagaaggccgtggaatcgcgtaacttcgagattcgtaagaacgtgctcaagtacgacgatgtgatgaacaagcagcgcaccgtgatctactcggaacgtcaggccgtgttgaagggcgaggacattcacgaggacattgaggccttcatctccgacacgctcaccagctatgtgcgaggcgcgaagaatggatccgacaagccagccgattgggattggaacggcctgttcaaggctgtgaacgacctgtacccgaccaaggtgaccattgacgaggccaaggaggcggcggaagggctcaagggcgacaaggccgtggacgccgtggtcaagctgttcgtcgacgacgccgaggcgcagtatgaggccttcgagaccaagctcggcgccgatggcctgcgtacgctggagcgtcgcgtcgtgctcgccgtgctcgaccgcaagtggcgcgaacatctgtacgagatggactacctcaaggacggcattggcctgcgtggcatgggccagcgtgatccgctggtcgaataccagcgtgaaggctaccagatgtacaaccagatgatcgaggccatcaaggaggagacggtgcagttgctcttccacatcgacctcgacagcatcgcccagacgaacgacgacggcactgactccatcgacgacgcggcggtcgattccgccgaaatcaagatgggcgacgatgtgagcgaggacgacgagctgaacaagggcaatctgtcggagcacgagcccgaagaggccgcgcgcatcgacaatcatgccgacgagctggagaccgccgagaacatcgctgcggtcaaggaagcggcggaggaaggcgagcggattccggaatccggtctgctcggcccggagccgatgagccatgccgagggcaaggtgccggcgcgcaagcgtccgaagagcgaggagctcaagaccccatggtccgacggtcgcacattcccgggcacgccgaagaacgcaccatgcccgtgcggctccggacgtaagtacaagatgtgccacggccagaacgagcagtgagcatattcaacccgatatcgaggggcgccgcatgcggcgccccttttgtgttgaccatgatgcgggactcgacatgtgttcgttgcttgtgttccctagactgtgcgtagcagctacgaaacgaggagtggtcatggccgacatcacatggaaatcgattctcaccaagctcgtgcagggcaatcacctgactgccgaggaatccgagtggttcgtcgatgacctcatgaagggcaacgccaacccggcagccgtcggtgccgtgctcgcgacacaacagcagctcggattgacggccgatgagatcgctggtgccgcaaaggcgatggtgtcgcatgccgtgccgttggaagtgaaccgtgaatgcaccgacatcgtcggcacgggtggcgatggcgcgcataccgtcaacctatcgacgatgggggcggtgatcgcagccgctgcgggcgtgacgatcgtcaagcacggcaaccgcgccgcgagctccaagtgcggggcggccgactgtctggaggcgctcgggctgccgctcgatctcaaaccgcaggccgtggccgaggtggccgatgaggtgggcatcaccttcgccttcgccaaaaccttccacccggcgatgcgattcgtgggaccggtgcgcgccgcgctcggcgtcccgtgcgtgttcaacgtgcttggcccgctgacgaatccggcgaccccgaagcatatggcaatcggttgcgccaaccgtgcgatgagcccgatcatggccgcggtctacgcggcgaacggccagagcggcatggtgtacacctcgaacgagggactcgacgagatggcgccgaccggtccgatctccgtctgggaattcaaggacggcaaggtctgcgaaacggaattcgacccgatcgaggagcttgggctcgccaaggtcacgattgaggatctgcgtggtggcgagccggactacaatgcccaggccgcccgcgatctcttcgccggaaaggatgtgccgttccgtacgacggcattgctcaatgccgcctccgcaatcgtggcggatggctcgcttatcgatgcctccgctcctctgggcgaacggttccgccaagcccatgccatcgccgaacaggcagtcgattccggtcgtgccgccgccctgctcgacgagtggatcgccgtcgcaagcaaacatgtcgactgagttgtaggagtacggggattacctggtccctataaccagaggtgccattcggctatgcacggccgaatggcaccttgttctttcgggaatcctatacgcgagcgccgtcgtcttcctcgtctcgcttcgtttcgtcatgaccgcggtgtgtgacgaacaggccaccggcgccgacgagtatcgagatgccgaagacgatgccgagcacggtcgcccaggctggcagaaacgccgtggcgatgatgccggcgacgccgacgacgagcagaatgccgcagatgagacgcgaccagcgaatctgacccagatcgggattggggggagtgaacacgctgctgcgatccatcacatcgtcggtgtcgagccaactcgattgcgtgaaatcacgcgggcctgacgaatcgacgaaactgccctgtttgaggtcgttcaccgaaagaatcgccctcttctcctcgcgtttgtcctgacgcgtggcgtgcctgtcgaatttcctcgcggtgcgtgatcgctccacctcgcccagatcgtcggaatactcgtcgaggaagcgattccaggcggcctcctcggagatctcgctcgaatcacccccgttgcgcccggaatcgtgtggcttcgtttcttcgccgtcgttgctattgttgaggtcagtcataggttcactgtagcaagcggatgctatgagacatgtaggaggaggcagcatgttgtattggttcttcatgagaacgctcggtccggtggcgcggcatcgtttcaagcccgtggcagaagggctccagaacattccacgcaccggcgggggcatcattgcagccaatcatctggctgtgatcgacgatgcgttgctaccgctcacctgtccgcgcatgattcatttcatgggcaaggcggagtatttcgaaggcaagggcatcaaaggcaagttcaagaagtggtggttcacctcggtgggcgtgttccccgtggatcgttcgggcggctcaaagtcgctcggtgcgcttgagcatgcacgtgagatcatcgaggaaggccacctgttcggcatccacatcgaaggcacccgcagcccggacggccgtctatacaaggggcacaccggtgccgcgcgtctcgccttggaaaccggttgcccgatcattcctgccgccatcatcggttcacgcgaactgcagaagccggggcaggtgattccgggcaaggggcactccaaggtgatctatggtgaacccatcgaagtggagaagactccatctgacgaggtgacgcatgaacggctgcgtgagctcaccgacgaaatcacgcgcaggatccaggcgatgagcgggcaggaatacgttcccgaatacgcccaggtggtcaagcagcagatgaaggaggagcaggacgtgctcgattccgctggcgcagaggcagcagctgatctcgagcgtgaacatgaataggctgacctgagtctggctctgggacacaatgtatacgcgcatacgccgctcagatcaccgtgagtgtgatcaccgttttcttgccgtcttcgccacgcagacgcacctgctggccgcctttgggatcttggaatcgcacggtgtgcaggaggtcgcccaacggtgatgagaccttcacctcaaagccgaggtcttcaaggatcttcctggcctcctccgtcttcttgcccgtgatgtcgggaacggtcaccatttcagggcccttcgagacggtgactgtgaccgcatcgccccagtgcaattgggttcccgcctcgggatccactgaaatcacctggtcccgtggaatcgtatcgctgtactcttcggtgtaggtcgccttgagcttggcgtcatcaaacgacttctgcgcctgaccgcgcgtcatgcccaccacattcggcattgccaccggcatgggccctttggagagcgtcaccacgacgtcgtcgttatggttctgtgtggtgccggcgctgggcgtgatgtcgatgacctcgccttccggaacgctttcggaatactcgtcgttgtcttcgctgtgcgtgatgttggtgaagcccgccttccgcaggtcgtccagaggggacgagctgctcatgatgccttcgggaacggtggcctgctgcacaccttgcgacaccgtcacatgcacctcgccgctggcccgcttgctcacatgggcatccacaaattgcgggtcggtggagatgatctcgccggcaggcactgtgtcgctatactgctgtgtgcttttgtacggaatctgcgagactttgagcagacgctcataggcatcccatttcacacctgtgatcttgcatggcgcattttcggcacaactgagcccctcgggtttgggcagtgtccagtagctgccaggccccacgaagtaccacaatgcgaatccgccaccggcacccaatgcgagtatggcggcgatgatcgaaacgatcatcgccgttctatgcttcttgcgaggctgcacttgcgtctgggcattgctgggcaatggcgcacctggctcgccgggacggccggaattacgcccataacttccggtagagcctccatatggtggaacggtggttccaccggaggccggaaccccagagcctggcgtcgaggagtcgtccggcggtgtggcgagagctaccgttcttgcctgttccgcctcctcttcagtgagatcgggggaggccaatgcagtgaaaagcgcggcggcagaggtaggtggtggagtggattcttccggcgaatccgatttgctcgaaacggagggacggtcggaatcctgctcattcgcacccattgggaacacccgagtgctgttgatgggtggttcctgggggcggaagcgatagtccaatgcctggcggctcagcgtgggcatgagctcacggaggcgatccaacgccttctgtgcgcttttcggacgggcattgacgtcacgtgcggtcaggtacgagatgaaggccgaaacccgggggtcgatgccgtagcacaccgttcctatggaggggatgttctcgttgacgtgcctgaacaccatcgtcaccggattgtctgactggaacggcaccctccccgccagcagctcccatgccatgatgcccacggaatagcagtcgccctgaggagtggcctggttgttttcgatcatctccggggcgagataggccgctgtgccaagcagcatcccggtggaggagagcgtggcctgcgaggcggccttggctaggccgaaatcggtgatctccacatgaccgcggtcgttgatcagaatgttctccggcttgatgtcgcggtgtacgacgccgatctcgtgggcggcggcaagtccgttcaatgtctcgccgacgatgcgcagggtgtcgcgcaccgagaacgtggtgtgcgtctgcatctgactacgcagattcacgccgtgcacatactccatgaccagatagtacgagccattcgtctcaccggtgtcgtacacctgcaccacatgcggattggctattgctgccgcggatttggcctcccgtcggaagcgctcgatgaactgctcgcggtgggggccctgggccagctgcatgtgcatgattttgaccgccacattgcgcccgagcctttcgtcgacggtctggtacaccgtggccatgccgccatccgcgatcttgcgcacaatgcggtagcggccgtcaatgagattgtagtggtccgtgccgtgtgccgtggtatccaccatgctggttgtgttccttctgctgtgatgccccgattgcgagtgtgccttcggaggatattttaccgttcggctgtgaaatccggcagaaagcgctcacaggctttacgaaggctttgcgattgtgcggcggtgagacccattgcttcgatactttcctgggtttgcgaccacagcttcgcgatacgttcgtgcgaatgctcgatggccccggtgtcatggaacagcgcaatggtctcatgcacctgcgcgtcggagcggaacggctgctcgtacagctgctgcagctgtacgcgttgtgcggcggtgcccaacatcatggcgtcggcgagcaacaccgtgcgtttcccctcacgaatatcacctccgacaggttttcccgtgctgcgggaggagccagtgacgtcaagcagatcatcggccagctggaatgcctgccccaatggcagccctatggcatggcagtggaggttggctgcctcgctggtcataccggatgccaggaatgccagcatcaacggggcaatggtggtatagctggcggttttccagcgaaacacgtcgagcgacgcttcggcaagcgcttgcggatcgtcgagtggcatgcgctcaatggcaaggtcgagcacctggcccacctccacgtcatgttgcatcgaaagaaaggcctccaccaagcgtcgatgttcgaccataccggtgctggcgtcctccatgatgagcgtgcatgccgtggcgagcatgtcgcccagcatgaggcccagcccgcggccaatgctgcgtgcgccggcgaacgaggtgagcgcgcagtgcgcggagggcttgccgcggcgtagatccgagtcgtcaatgaggtcgtcgtgcaccagtgcggcggtctggaacacctcaatggcacaggcgaagtcaagcaccttggtgcgcacgcttcgcgattgtgtggaatccggggcgccggccagcacatcgtaggcatccagtgtgagtagcgcgcgcaggcgtttgcccccttcgcttgaggcgagcgcctgatccaccactgtatggaacatcgggcgcagagccggggtgatgggtgcatctgtgccgttcacccccacgtagtcgtgcacaagttctcgaatgcgggtttcaatggcgccgatactgctggaatcgctcatggttccagtgtattcacagcattccgacattgcaggtcatgcacaatatgcccgacctgcaatgtggataacacgttctccgaccacaaatgcccgttgggatggaatcctttccattctgccgccacagtggatgcaaggcccgtttgggtcgcaatgcaagacggacaaggagtagatatggtgtcgaacaatgaacacaacgaggaagcggagatgaaccgggaagacggcggtatcgcgggtctgggcatgcacccattgccggtggcgcggctcgggggtatgcgccgcgagtatttcgagcggatgaccgacatcggtacggcatcggcggcggcccggtggatcgccgatctgctgcctccatggctgacgtggctgcgggagcctgaaatgaagccgcaggatctcgatgatgaggtgcagttgatgttggtcaccggtttcaacatctcgttggcggtgcgcgatgcgatcatcatgacagtggtggcggacgagtcgcagtgggacgaaggcgtcatctcacggttcgccgcgcatccccatgacaaagatgtggcacaatctatgtccgccatgcttaccgcggccttcgaggaacccgaatcggacgaacggcggtgcgtgcgggtcgtcgaactgcttcacacgatgtcggggcgtcttcccgccgaatgcaccaggcaattgcgggcggtgagggcctatcttaaatggtggcgtggcgacgagtccgcgctgcacgatgcgctcggggtgctcgaggaggatgaacgggtcacattggcggctatcgtcgcggctgcggtcacccgacacgtctacccggcacatgcaggccgcgccgagacggaggacgcaccgattgcaggcacctgagggtctatgggaataatcgtcccgaagacatggttaactcacatagtcagcgacttgaccttgccgtagctatgcccaaaagcaagcatacgacggtcggccgcgttccacaagacccagggaggtacagtttggtcgccaaggaaacgacgagcaccgagaaagccgcgaagaagaaggcctccgaaagcgcccacgacgaagccgccgtcgaagagaagggcaagaccacccgtaggagggcctcctcgaaggcttcgtcggcgaagaagggctccgccggcaagaccaccaagcgtgccacggcccggaagaagaaggatgccgccgagagcgagtcaacgccggcaaggaagactcgtgcggcttcgaagaccggcgcgaagaaggccatttccaagtccgaggagatcgacgacgaggacatgatcggtgaggatgtgatcgacgaggaggatcttgacctcgatgaggatcttgacgccgacgagaacgatgacgacctcgaggacgaggagtcggaggacgaacccgagccggaggaagacgacgacgaagagccgcaggccccgaaggagcccaaggagaagggtgcgttcgtcgtcagcgacaacgatgaggacgacgaagcccttctggcgaatccgggcgtgaatccgaagcgccgcgtggtaaccacgggcgcgaccgccgacccggtgaaggattatctcaagcagatcggtcgtgtgagccttctcaatgccgaacaggaggtcgacctctccgagcgtatcgaggccggcctgtacgcccagcatctgctcgacaccgagggcgacacgatggagttcagacgcaaacgcgaactcaagtgggcagccgccgacggcaagaaggcgaaggaccacctgctcgaggccaatctgcgactcgtcgtctcgcttgccaagcgttacaccggccgcggcatgctattcctcgaccttatccaggaaggcaatctgggtctcattcgcgccgtcgagaaattcgattggaagaaaggcttcaagttctccacctatgccacctggtggatccgtcaggcgatcacccgcgccatggccgaccaggcccgcacgattcgtgtgccggtgcatatggtcgaggtgatcaacaaactctcgcgcgtccagcgccagatgctgcaggatctgggccgtgagcccacgcccgacgagcttgcccgcgagctcgacatgccggtggagaaggtgcaggaagtgcagaagtacggccgcgagccgatttcgttgcatacgccgctgggtgaggacggcgattccgaattcggcgatctgatcgaagacaccgatgccatcgcgccatcggaggcggtcgcattctcactgctacaggagcaattccgtcaggtgcttgaaacgctctcgccgcgtgaggcgggcgtgatcaagatgcgctatggtctcgaggacggccagccgaagacgctcgacgacatcggccgcgtatatggcgtgacccgcgagcgcattcgccagattgagtcgaagaccatgtcgaagttgcgtcatccgtcccgttcgcagacgctgcgcgacttcctcgatcagtgacgctgaacggcgtccattgccggcgcaccccgatgggtgcgtgccgacgccagacgacatgacagtgccagggagagcgtgagccgagtggctccgctctcttttgcatcgaagaggagatacggaggagggttatggcgaagaaggaacccggcagctacggcgccggctcattgacggtgctggaagggctggacgcggtgcgcaagcgtccgggcatgtacatcggcaccaccgacagccagggtctcatgcactgcctgtgggagatcatcgacaattcggtggacgaggcgctcgccggggcatgcacgcatattgtcgtcaccctgcacgaagacggttcgatcgaagtcgccgacaacggccgaggcataccggtggatgtggagccgaagacgaagctcaccggtgtcgaggtggtgctcaccaagctgcatgcgggtgccaagtttggcaattcgtcgtacaacgctgccggaggtctgcatggcgtgggctcgtcggtggtcaatgcattgagctcgcgcatggacgtcgaagtcgaccgcaacggccacacctaccatatggcgttccaccaagggcatccaggtgtgtataccgacgaggacccacagcgtccttcccccgactcaccgttcaagaaaacgcgcaagaaccgccccacagagctcgagatcatcggcaaggtgcccccgaagcgcacgggcacgcgcatccgctattgggcggatccggaaatcttcaatgacaccgcgaaattcgactacgaacaactgattgaccgtgtgcgccagacgagcttcctggtgccgggtctgaagatcacggtgatcgacgaacgcatccgtgagacaggcgacgtcgacaccgacgtgttcgaggagaccgacgtcaaacaggcgcaatccgacccggtcgagcggatcgaggcggagaccgaggcaagcgagaatcctgcgaagatcggccttgagcgggcgaatgcggaggacgcgcaggaacaggcacaggacccgcagcaggcagtcgcagccataccggtcgtgcaatctgcggattcgggcgcctcagtgccgggacaccggcgtgtggaggaattctgccataccggtggcattgtcgatttcgtggacttcctctcccacggcgaggccgtttccaccgtgtggcgaataagcgggcagggcacgtaccatgaggagacgcaggcagtggacgcgaacggcgacctgcatgcgcagaagatcgtgcgaacctgcgatgtcgatatcgcgatgcgttggacgaacggctacgacacggtgttgaagagcttcgtgaacgtcgtcgccacgccgggcggcggcatgcatgtggacggcttcctgcagggtatcactaagcagattcgcaagacggtggaagacaacgcgcgcaagctcaaggtcaatctcaaagacccgaagatgaagatcgagcgtgacgacattctcgccggattggtggccgtggtcaccgtgcgcatcgccgagccgcagttccaggggcagacgaaggacgtgctcggcaccgcgccggtcaagccgcttgtcacacgcatcaccgacaagcagttcgccgagctcatcaccggcgcgaaacgcgggtacaaggagcagtcggcgcgcgtgctcgagaagatcgtgggcgagatgcacgcgcgcattcaggcacgcaagaccaaggaggtcacacgtcgcaagaacgcactcgaatctgcttctatgccgagtaaactgtcggattgccagccgggcaacgacgacatcgccgaactgttcatcgtcgagggtgattccgcactcggcacggcgaaggccgcccgcaattcggcgttccaggcgctgctgccgatccgcggcaagattctcaacgtgcagaaggcgtcgttgtcgcagatgctttcgaacaaggaatgcgcgtcgatcatccaggtgatcggtgcgggttcgggggccagcttcgacatcgagtcggcgcggtacaacaaaatcgtcatgatgaccgatgccgatgtggatggcgcgcatattcgcacattgctgctcacgctgttctaccggtacatgagaccgctcgtcgaggcggggcacgtgtatgcggccgtgccgccgctgcaccgcatcgctttggcgggggcacgcaagggcgagtacatctacacgtattcagatgacgagttggcgggcaggctcgcgcagctcgacgctgagcatattccgtatgccgacgacatccagcgctacaagggcttaggtgagatggacgcgaaccagcttgccgacacgacgatggatccgcgcacgcgtctgctgcgtcgcatccgcatggaggacgccgagcaggcgaacgacatcttcagcctgctcatgggcgacgaagtgcctccgcgccgccagttcattgtcgacaacgccgaggatttcgaccgttcgaagattgacacctgacgctttcgtgcaaccgatgcccacaggggcccggaacccgcgctgaggagcgtgctctacgcgcaaagcgcgcagacactttgacgaagcgcgggttccgggcccctgtgggcatcggtctcgcacgatatgggtcagtcggcgtggcgagccgccatcgcctggccgtagacctgttccacctgatcggtcacggtgcgaacgttataccgatcgagtagccccgcttcgcgggcatgcaggtcggccgcccaaggttcgtcggtgagtgcgcgggcaatgcgttcggcaagaatgcgggcacggtctgttccactcaccgggaagagcgagtcctcgtcatcgagcatggtcgaccggtagccgggattgtcaccggccagcgtgacaccggcattcgaggcgatggcctcgagcagcacgatgccgaaggattcgcctccggttgcggggaagatggccacatcggcgctcgccagcagcttcggcttctcctcttcctccacgaagccgaggaactcgatcggcgtgcgcagatgcgaggcacgttcccggcattcgtcgagcagcgggcccttgccggcgaaccgcacatggaagccccgcgggaacagatcatgctcctcgccgtattcgacggcatccagaagcaattccgcgccttttctcggaacgaatctaccaaggaacaccgcgaggggtccctcggacgagtgcgcactggccgtgtcgccctgcacaatggcatgggtgggggaggcgcctgcgaaccgatcgacatcgacgggattcggaatgacgacaccgcgaacatgcgcggtctgctcggcatactgcgcggcgatctgggagactgcgatcacctcgtcgacgcggcggtgggagtgcatattgaccagcccgagcgcacggccgccgatccgggaggcaaggtcggccgatgcgatgtggtaggtggcgacgacgccagtgcgctggtgcgcatggtcgagcaccctggctgccatgaacgggctgtagggcgcctgaacgtgcagaatgtcgaaatcgtattcgtcgagcacctcgcggatatgccgtgtgttggccggaagcgggatgcgcatgcggtttccgttgaaccggaccatgacgttgcgtgacatcggatgcgtgttcggcacgggggagtcatgcgtctcgccgaccagataatgcacctcatgcccccgtcgcgccagctcctggcccaaggtcacgatatgctgctgcacgccgtcgagcacgtccagggtgtcgtcgaacacgaatccgattctcaagctcatgggcaccagtctaatcatcgaacagatttcgaagaaccggatattttctttacgtaagaagataattatgggctgtcgatgcagaaactggcgcacactatttggaggtgcaatgacgaatctgctgctcgccgtaatctacttggccttcatctcgctggggctgccagacggactgctcggttcggcatggcccaccatgagcggtgacctgcatgctccactgtcgagggccggtggcatctcgatgacgatcagtgccggaaccatcatctccgcactgctgagcgaccggctcacgctgagatttggtgcagggcgtgtgacggcgttctccgtggcgctcactgcggccgccctcatgggattctccttcgcaccgaactactgggttcttatcgtgtgcgccattccctacgggctcggcgcgggtggcgtggatgcggcgctcaacaactacgtggccatccactacacgagccggcatatgagctggctgcactgcatgtgggggctcggcgcgctcatcggaccgtacatgatgagttacgccatggcaagccggcatggttggcagtggggctaccgttcggttggtgttatccagctcgtgctcaccgccgtgctcatcttcagcctgccgttgtggaagaggcgccccgctgccgcggacgcaggcacgcaggccacggaccgaaagccaatcggcctgctcggtgtattgcgcatcagtggcgccacgcagattctcatcatgttcttttgctactgcgccatcgaacagaccgccatgctatgggccagctcctacatggtcggcatggatggcatggccgaagacgtggctgcgacgttcacgagcatcttcctcatcggcatcaccgttggccgattcgccaacggcttcctcaccatgcgcttctccgatcccgccatgattcgcatcggcaccatgacgatcggcctcggggcgctcctgttgctcgttcccgtgcacaaccccgccctctccgccgtggcgttcatactcgtcggccttggatgcgctccggtctatccgtgcatcatccactccacgcccacatacttcggggccgataaatcgcaggcgatcgtcggtgtgcagatggcgttcgcgtatgtgggcaccatgctcatgccaccattgttcggcgtgatcgcgcaggccacgacgattgccgtgctgccatggtgtctgctggtgttcgtcgcgttcatggcggcgatgcacgagtggctgcgcgcattgcgacgcgacgacatggccgtctgacatgttcgtaacaggcgatgccgtgccatatgcgccgtcgatgcgccttacgatgaccgtgtatgcactgtataggcaaatatatgcagcatgtaatccgagccgacgacgtctgaatgagggggcgatggcatgccgatggcgttggtggcgttggtatacgttggcttcgctgccatggggttgccggaggccccgctcggtgcctcgtggccggctatggggtcgggactgcatgcgtcacttgccgccgtcatcgggatccccgtcgttatcgccgcaggggccatgtgggctgcgctggccggtgagccttggctgcgtcgctggggctcggggcgcagtgtggatgttggtgtggcatgcaccgtggtggcattgcttggcttctcgttcacgccgtcatattggctgctgctgttcttcgccgtgccatatggcgtgggctccggcctgcttgcgctcgcgctcaacgcatacatagcattgcgcttgccgagtgcgcatattatttggatgcacgccacgacggccgcaggtgccatggcaggtcatacgatgctcggttggatcattgcgaacgatgccgactggaggtgggcataccgctgcataggccttgtgcaacttgcgctggccatcgtgttggtgagtgccacgaagctgtggcgcgacgaactgacccccatccagcgcgccacattcggcatgcaggcatatggcgagcgtgattggcatgtcgacgcgcatacgcatggccgtctgggtgcgagccctgagattgcgcggcgcgttcccgacactgttgcttctgttcgcctacgcttcggtggagcagagcaccatgctgtgggcgagcagctacatggtgcatgccggccacatgagcatccattatgccggtatctacgcgaacctattcttcattggattgacgctgggttccgtgatcgcaggatgcttggcgctgcgattgtccgacggcgcgttgctcggcggcggcttgggcgtacttgttgcggcgcttgtggtgatgattgtgcccatggggtcatggcgcgccctcgtcgcgccggtcatgctcgggtttgggtgtgccccgattaatccggccgtcgtgcatatgacaccacggctgttcggcgctgttcatacgatgaccatgatcggctgggagaccgccgtcatcgccgtggccacactggtgagtcccgtattgttcgccgtgttctctgccacggtgggcatggcggccctgccgtggtacttggcgtgtttcacgtcgcttggcatactggccgccgtcattctcatgagcgtgtcacatttgcaatcgcgagcgaggtaggaaataatcgaacatatgtgcgaatgtatggcaatgttcagcgaacccacacgcgtgtggttctcacgtgtgttcggagaacccaccgaggcgcagcgattggcatggccggcgatcgggcgacgcgagaatgtgctggtcatcgcgccgaccggttcgggaaagaccctctccgcgttcctgttcgccatcgactcgcttctgtcccgcagtgccgccgaccatgcacgcaaaggcgtgcgcgtgttgtatatctcaccgttgaaggcgcttggcgtcgacgtggcgaagaaccttgatgtccctttggccggtattcgcgaacagatcgatgcccttggctcgcatgcgccgcaggtcaccgtcgccaccagaagtggagatacgaccccgaaggagcgacgtgcgatcatgtcgcatccgccggacattctggtcacgaccccggagtcgctgtatctcatgctcacttcgaaagcgcgcggcatcctgaaaacggtggataccgtgatcgtggatgaggtgcatgcggtcgccggcacgaaacggggggcgcatctggcgctgagccttgagcgtctcgatgaccttctggaacggccggcacagcgcatagggctttcggcgacggtgaacccgcctgagcgtgccgcgaagttcctcgcaggagcattgccggtgacggtcatcgccaccgggggaaagcctgcactcgacatcactgtggtcgaaccggcgaagacccttggtgacgggcccgtggccaatggcaggcgcaaggggggtgctggggaggtcggcagcacttctgcgccaatgaccggcgtgacgcccgcgatgcaacgcttggcggagcgcaaggcgagggaacgggatggccaaggcgatccgcaatctgcaaccaccggcgagacaaccaagcgatggggggattcgctgccgccgggtacgccggtgagcgaaggcgcgcacaatccgtcgggggtgaaatccgcgtggccggcgatccaacgccatattctcgacgagatactctcgcaccgcaccacattggtgtttgtgaattcgcgcggcctatgcgaacgcctgaccgcgcagatcaacgatctgcacgcacaacggctcggcaaacgcaatccggtggaactgccgaccagcgagacggacgagccagcccactatcattccacgtatgggtccaccacaatgaaagtgggggcgcacggccctgacgagcagattgccatggcgcatcacgggtcggtgtcgaaagaccgccgcaagcaaatagaggagagactcaaatccggacgtctgcgttgtgtggtggcgacgagcagtctggagctcggcattgacatggggtcggtggatctggtgattcaggtgacgccgccgttgtcggtctcctctggcctgcagcgcgtgggccgagccgaccatagggtggggggagtctcgcacgccgtcatgtacccggtgacacgcgaacagatcatcggcataggtgccagtgtggaaggcatgctcaacggggcgattgaaccattgcatatgccaatgaatcctttggacgtgctcgcgcagcagaccgtggcggccgccagtctggagcccatcgccgccgatgattggtatgcgacggtgagacgcgccgcccccttcgcctcgttggaccgggcgatgttcgacgccgtggtgggcatgctcaccggcgcctataattccgaggacttctcggcatttcgaccaccgctcatgttcgacgaggattcggccatgatctcggcgcgtccgggtgcacagcgcctcgcggtgaccagcggcggcacgattcccgaccgcggtctctacactgtagtgctgcccgaggccgaggcgggaacaggtccgagacgggttggtgagctcgacgaggagatggtgtatgagacacgggtgggtgacatcatcacactcggcaccacgaattggcaggtgcaggaaatcacgaactcccgcgtggtcgtggtgccggcgcccggacgaagggcacgcctgccgttctggcatggggagggcaacgggcgcgattattccttcggcatgtcgcttggggaatgggtgcatgacatcgccgcgggattgcaaccggcgcacggcaatgtcgggaacgcgccggaatcccgattcagcgacgtggttctcaaacgcctgcgagccgatggtctggacgccaacgctatggagaatctggcggccttcctctccgagcagcgggcgagcaccggtgtgatcccgagcggtcgtgcggttgtggtcgaacgctgccgcgaggaggagggcgattggctcgtgatcattcatacgccgttcgggcgtcgtgtgcatgagccatgggcgctcgcaatcaacatgaggttgacgcagcgttatggtttcgacgggcagatcttcgccgccgacgatggcatcgtgctgcgtctgcccgatggggaaggaggcatcgacgtcggcgcgctcatcgacttcgaccccgatgacattcagcgcatcgtggagaaccaggtctccggcagtgtgctgttcgccgcccgattccgtgaggtcgcggcgcgtgcgctgttcatgccgaggaacgacccgggcaaacgagtgcctctatggcagcagaggctgagggccacccagctgctggccgcggcgcgcacgaggaagaacttcccgctgctgctcgagaccgcccgcgaatgtctgcaggacgtctacgacgttcctgccctccgcgaagtgctcacccgcatacgtgggggagccatcgacgtgcatgcatgcgagacgcaagtgccatcgcctatggccgagcatcttctgttcggtttcgtggggtcggtgatgtaccagtacgatgtgccgcaggccgaacgcaatgcgcaactgctctcgatggatccgctggtgctggaacggttgttggggacggacaacctggcccaggtgctcgatacacaggtgatcgattcagtggccggccagctggcttcgaagaccttctggaacgaactcgacaagcacgatctgcggggacgcgtgaatcgctacgccaagacgcatggaccgttcactgccgatcgcctgctctccgaacttgagatcgacgcgcagacggccgtcgaactgcttggtgaactgcgcgatgccggcgagctcatcaacggtcgtttcgacgaacgactcgctccgggggtgacgcaatgggtgcatgccgacgtgctcaaacgcattcgctcgcagtcgttggccaaggcccgggcggcaatcaaacctgtggaacccgagcggtacgaggcgtttctcgttcatcggcagggtgtcggctcggtgggcggcgaacggttgcaaggtctggatggactcttgcgtgccattgaacagctggagggtgtcgcattgccgatgcccgtgtgggagcgccacgtgttcccggcccgtgtgcgagattacacgccgacattgctcgacgagctggttggctccggcgatgtggtatgggtgggtgatcccacgggcagcggcgaagggggtgacgaggcgggacgcgtcatgttcttcccggcggactccccacagttgcaggtgcatgctgaggcattggaatcctccctaggtcgagcggctgcgccggaatccgacatgccgctgacggtgcgcgatgcgatactgcttgccctgcacgacggtggcgcttacacggcgcactcattggaggagcgtgcgcaatccctgtggcaggcgaatccggagccggaggtgaatgagacgaccggcgaggtgatggccacatcatggtcccattcgcgattcgagcagaccctatggtcattggtctggcatggattcattaccaacacctccctgcaaccagtccggtcggtgtcaacgcatacgggtggaagtaaggccacggtgcggtcgcatcgtctccgcttgcgtgcccgaatacccacacgcggtatgttcggcggcggtctgtggtcactggtgcgcacccaaggcgatgcgagccatgaggaggcgatgatcgacctgataggtattctgctcgaccgctacggcatcattgcgcccaatacggtgtcagatgccggtgtcgccggcggattcagtgccatttatccggtgctcaaacgcatggaggagaaaggcacgctattgcgaggtgtattcgtcaaggggttcggtgccgctcaattcgccgagcgggagacggtggacctgctgcgtcaccatatcgattccgagcctgtcatgaccgtcaccatggatgtatgcgatccggcgaatctctatggttcgtcattggaatggccggcgccggccatacttgaatccaatgcccgcacggactccaaacggcgcgctgccgtgaaaccaatacgacgcccgggctcattggtggtgctgcgtcaggggcgcgcggtgctgtatgcggcactgtggtcgggtcgtatcgtggcgttcgagccttcgccgagcgtgcttaaaacggcggcgacggctttggaacagacatgttcgcgattgcatggggccagcatcactttccgtgattgcaacggcgtgccattgcagggcggcaacgcgatgtccgacgcccttcggcatgccggattcaccccgtcgccgcaggggctccgactgtatcgatgaggcgggtatggcgggcagcctcctcgctatgagcggaagagcggtccgaacgtagcggtggaggtcctagaatgcttgtgttttgcgttctgcgtacaacgatttggcattgtacagggaaaggacttcacatgggcatgctcattgcgttgttgccggcattgttcctcggctcgaacagtgtgatgacggcgaagatcgacggcaagccaagtcaggggacgctgggcaccaccttcggcgcattcctcttcgcggtgctgatggccgtgtgctacacgattccccatgcaggggcatcgttcgcgttcaatccccgcatctgggtggtgggcctatgctccggcatattctggacgataggatccatcggccagttctcggccttgaaaccgctcggcgtctctttggcgatgccgatctccacggcccgtcaggtggtgggcaatgcgctcatggccgccatcgttttgggggagtggcgctcattgcgagtctgggtgatcgggatcatcgccatcattctcgtcacctccggcgccatactgtgttcggccagagattccgtcaccgatgccgtgcatatcagtgcgaagaacatgaaattcggcatgatcgccctgctcatctccaccatcgggttcatgatgtacttcgtgttcccgaaccttctgcacaagaccgggtatatcgacaacgctatctacaatgcgccggacggtaacggcctgtattatatgaccgcaatgatcctgccgcagtcggttgggcaggtgctcgctgcagtcgccatcattgtgcttggcgagcacaaccagtcgctcatcttcacccgcaagaccgcgctgaacatcttcactggcctctcctgggccataggcaactgcctcatcttcatctcggcagccaacccgaatgtcggtcaggccatcgccacgaccttcccccaactgggagtgctcgtctccaccttcggtggcatcgtgatcctcaaggaacacaagacaagacatcagatgatctgcatactcttcggcacattgctcatcgtggcaggtgcggtgcttatggcgatgtacaccaccacgtgataggtatgaagtcggtatacgacaggcctcggtcagagctactctgaccgaggcctgtcgtataccgactctgcgatctcacttaggccgcgtaggcgatcggtgcaggcagctcggttcccgaaccatcacgacgcatatccggcgccggcagctcgacgggatggccccccgacgttgcggccagcagcgggtaggaacccacgcacgccctgatcaacgtgttctgccccttgaggaagcgctgcgagcgcacaccaccggtcgctcttcccttggtggggtagagctccaatggcgtgaccttcgccgcaccgttctcggtgcccggcagcgcatccacatcgccggcgacagtgagcaccacggctccactggcgggagagagcagattgcctgcgtcatcgtgctcggcatcatgccattcgacatcggcgtgcgcaaccacggcgcaggagagcaccgtacatccatcggcgagatgtatgccggccatgcctgccgcagtgcggccctggggacgtacattcctggcctcatacgtgagcagcgaggaatcggaggaaacgaacacgaagcggtcgtcgtcatgcgcatcggccgccacaagcagctcgtccccgtccttcaaatcgatgatgctccaggaatccatcgtggtgggggattcacggttccagcgcttcacaatgccgttgcgtgtgcctaacccgaccggcggcagctgtgccgccgtatcgtcctgcccgacggtgtcgcgtagcgcgagcgtggcgatcacccgttcgccgggcaccggatcggtgctttcggtggaggtgagcagctcggtggcttcaatgcctcctgtgaggctcaggtggccggtgacctccagattcggcagctccaccacatgggcgagcaccatgcggcccgcggaggtgaccaacgcatagtcggcacgggtgcgtgccggcatcagcgagacgatcacatcgtcgggttcacgcttttcggtgtgagcgcctcgtttggcccaaatggtcagggcatcgatgctcatgcgggctatgagccctgaggcgctcaatgcgatcacgcatggttcgtcttctatccgcagcgcctcggcggtttcgccggccttacgggctgccgccaccgcatcggcggcgtcgagtacgttctccgcatggcgtgcggcatcgagtgcggcgtcggaaggcatgtcatcgccgtgggccacgactggcacgagccggccgtcgtcgccctcatcgagcagcaccgtccgtcgtggcgtgccgtaggttgccaccgccttgtccatctcgtcgatcaccacgccatccagtaatgcggccgagccgaggatgcgctccaattcggtgatcgacgactgaagttcgtcgcgttcggattcgagttcgatgcggctcatcttggtgagtctgcgcaggcgcaggtcgagaatgtattgcgcctgaatatcgtcaaggctgaatcggctcatgagtccgttcttggccgcctccgcatcgtcgcttgagcggatcacgcggatcacctcgtcgatgtccaccaaggcgagcaatagaccctcgaccagatgcagccggtccaacgccttctgacggcggaactcactgcggcgccggatgacaccacgccggtgttcgatccatacatcgagcagggaacgcagtccgagtgtgtgggggcgcccattcaccaaggcgacattgttgatggcgaagttctcttgcaacggggtgtgtttgaagagctgtgccaacacggctgccgggtcgaatcccgtcttgagctcgatcacgatgcgggtgccattgtgacggtccgtcaggtcgatggcaccggagatgccgtcgagcttatggttcttcacaccctcggagatgcgttcgagcacacgctcgggacccaccatgtatggcagctgcgtcactacgatggccttcttgcgtgcggtgagattctccacatgtgtggcggaacgggtggtgaccacgcctcggccagtctcataggcatctcggatgccttgtcgccctatgatgatccctccgcccggccaatcaggtccgggcacgtattgcatgaggtcgtcgagtgtggcatcgggatgcttcatcacgtatttggctgcggcgacaacttcgccgaggttatgcgtggccatattcgtggccatgccgacggcaatgcccgaggcgccgttgacgagcaggttaggaatcgccgacggcagcacggtcggttccttgagcttgttgtcgtaattcggcacgaaatcgaccgtgtcctcgtcgatgtcggcgttcatgccgagcgcggcgggtgcaaggcgtgcctcggtgtatcgcgatgccgcaggaccgtcgtccaacgaaccgaaattaccgtggccgtcgaccaacggcagccgcatcgcgaatggctgcgcgagacgcaccatggcttcgtagatcgccgaatctccatgggggtgcaatttgcccatcacctcgcccaccacgcgggcggacttcatgtacgggcgcgtgggcagcaggttcatctgacccatctggtacacgatgcggcgttgcaccggcttcatgccgtcgcgtgcatccggcaacgcgcgcgcgtagatcaccgagtaggcatattccaggaacgatttgctcatctcctcggcgagcggggtctccacgatgtgctcctcgacctgccgggggtcgtacccggccgctgcctgcctgcgacgcgtcatatttgctctcccttatccaatgaaccgtcccattctaccccgtccgcgccgaaagacccatgtggtgaaatgagttccgccacgcgtgcccacgagtccatcaaccgcgcttgaatagcagtatgagcgtagatattccagattccggcacactcctcggctttgttcccacagcacagtacggcgatgagattgacgccgaccggccgagcgatgtgccggctggtctcgggaatgcacagcagggagcccgtggaggcgcgctgcacatctccgcggtgctgccggcactcagtgcggccatcggcacaccggtgcgcaccgatgtgcacgtcgacgccgagggcttgcgccaacggctcggcatgccgcgcgccaaatcagcaattgtggtgctcgtggatggactggggtactggaatctcaacatgaagctcggttacgcgccctatatgcgctcactcatgaacgaaccgctcaaccaacgtccgatcagcacatgctcgccaagcaccaccacggcggccatggccaccttcggcaccggcacctgcccaggattgacaggcatggccggctacacgcagctcaatccccgcaccggcgcgttgagtcaactcatccagttccgtggtgccatacatcccgaagaactgcagacggaacccactgtgttctcgctcatcagcgatgccggcaaccgcgccaccagcgtggggctgaccagattcatggcgtccccgctgacccgtgcggcgttgtgcggctccgattacattggccatgacgatgcgaacaaacgcgtgcgcatcgccgccgacaccgccaaggaacccgggctcacctacctgtacatgcgcgagatagacaaggctggccacgcatacggttggcacagcgacgaatggcaggtggccctcgagcgggtcgacatgcgattggggcagttgcacaggcaagtcccgaagggcacgctcattgtggtcatcgccgaccatggcatggcgaccgcggaccaaggcgacgaggcgcgtatagacatggccttggatccggtgctccagcagggcgtgagactggtgggaggcgaaccccgcgccacgatgctgtatgcccaggatggcgtggatgccgagagcatagccgaacgttggcgtgcgcgactgggggaccgtgcgtggatccgcacgaaacagcaggtgattgattgcggtttgctcggaccaatgcggcccgacgttcctgagatgctcggcgatgtgttcgtctatgccgccagagagaacacgatcgtggacacgcgctcgcaaaccgaaggagccacccgcatgcccggcgtgcatggatcgcagacgatgatggagatggatgtgccctgcctcatcgatctcgtcgactgaatccgacatattcagtcgtgtttatgcggatccttgccgaacatgatctcgtcccagcttggcatcgatgcccggttcgatcggtgcggcgaatgctgctccgaggtgttcctgtggacctgtggctgttgctgggtgggggtgtcgtcgtcgccatgctgctccggctggctttgcacggcatccggcttgatggcaggacgctgggccccggtgttcttcggagtgaattgcgctggagccttctgcttggggtacagtgcgctgatcggcacacgtttgcgcagctgtgacggttcgtcgggtctgtgttcttgggatggagcgggctcaggtgcatcgtcggaatgtggggagtcagactggctggaggtgtcggtgcccttctgcaccggctcttcgaccgcggatggtgcagattcagactgcgaggcttcctcggcaggtgtcgtgccggcgtcttccggcatggcgtccatggtggcatgggcgtatgcgtccgcggcccgtgcggtatcggttgcggtgcgggcctcggtctcattggtcgtcagcgtctcctgttcgttggaaggttcctcgtttcccgacccattccatgctcgcatggtctgttcgatgcgcgccgaacgcgccgaatcacctggcaggtcgacggatgaggggagggcctcgtcgagggcggtctgagttcccgcatcgtcgaacgaggcgcctgtgacagatcccatctcgccgatcagcttgctcgcggcgttgttgatgcacaccacggtgttgtcgtgcatgttccacgaccattcggcgtggatccgatgccccgccgagatgaaggtggcgctgatgcgccacggttccagaccccgccgcgtcgccttccattgcaccgattcggggcgcacccgtgcggccgccaaggtgcggtcaatgagctcggagagcgtgcgcaccttgctttccttgggtgcgcgcacacgcaggaactgttcgatggcgtacttcttctccgcttcgatcgaggtggcgaatctgcgcacaatcacctcgctcagctcatactgccgagcgatgtgctccgggtcggcgccggcgcggatcagcgattggatctgcgaaatgggcagcgtgcgctgctggtgcaccgcggtggtgatccgtttctctgaacggatttgcttggcctccaacatggcccgttcgaatgtatcgtcgacacgcaccaggaacggcatgccgtcggccgtgaacaccaggtcaccgtccggtgtcacatggtcgaattgtgctgcggggaaggagccagtacccattttcacgccttcgtcgtcatcgaaaaatgtgaacatttacattgtgcccctcgtgtcggattttacggtgttgccaaatcgtgtatcctatgcggggaatacttgcgtagtattacacgttaatacgggtacgtaaaaacacgtaacgaaaggaatcctctcatggcacaggactatgattccccgcgtagcaaggacgaggacgaggagtcgctccaggcgctcggcaagagctcgcagaatgcctcgaacgacatggatgacgacgagaacgccatcgccgaggattacgagctgccgggtgcggatctgagcaatgaggacgcttcggtcaccgtgatccccatgcagggtgatgagttcatctgctcggaatgtttcctggtgaagcatcgcagccagttggcgtacaccacgcctgatggccagccggtatgcaaggaatgcgccgcctgatgttcgacgaggcatatgtggagccggaacgcaccgaggtattggtcgcaccggtcaatccggcacagccggtggagttgcattacatgcatgcgggggacgccggtgcggatctcgtgacgactgcacatgtggaattgggacccttccagcgtgcactggtcccaaccggtgtacgcatcgccttgcccgccggctatgtcggcctggtgcacccgcgatcgggattggccgtgaagcagggggtgacggtgctcaatgcgccggggaccatagatgccggatatcgcggtgagatcaaggtgccgttgatcaatctcgatccggaacacaccgcggtgttcgaaccgggcgaccgtattgcgcagctggtgattcagcgctatgtgcaggccgaattcatcgaggcgtccgtattgccgggttccgaccgagcggagcgtgggttcggctcgagcggagtgtgacgcgcgcatccatgcctgttcacgcatggatgtgcgatgtgcatttcggaggcaaaacgactaatctcaaatccatatcggaggagagcaaggagggttgagagcgatgagcgagcatgaagaggatctgcgccccgccaacatgctgggctgtgagatcagcccgaatccacttgacccactggcaccgatcgaggcgatgtgccgacagcaccatcccgatgaggacatggagattctgtcacgcgcttacacccgcgcggtgatccagcatgccgagcaacgccgtcgttccggcgagccgtacatcattcacccgttggcagtggcgcagattctggccgacctcggcatgggtcctagtgtcgtcgccgcgggattgctccacgataccgtggaagacaccgactataccctcgatgagtgccgcgccgagttcggcgacacagtggccggtctggtcgacggcgtgaccaagctgacgaagatggattatggcgattcggcgcaggccgagacgatccgcaagatggtcgtcgcgatgagccgcgatgtacgggtgctcgtcgtcaagctcgccgaccgtgtgcacaatgcccgcacctggcgctacgtcaagccctccagcgcgcagaagaaggcccgcgaaacacttgacgtctatgcaccgctcgccaatcgcctcggtatgaacgccatcaagactgagctcgaggaactgagcttcaaggtgctctatccgaagatctacaacgagatcgtcgtgctcgtcgaacgccgtgccggtcagcgcgacgtgtacctgaagcagatcatcgaggagatccacgaggatctcgacgacgcgcacatcgacgcctatgtgaccggccgcccgaaggactacttctcgatctaccagaagatgattgtgcgcggccatgatttctccgacatctacgatttggtgggcgtgcgcatcatcgtcgattcgattcgcgactgctatgccgtgctcggcgccgtgcatgcacgctggagcccggttcccggccggttcaaggactacatcgcgatgccgaagctcaacatgtaccagagcctgcacacgacggtgatgggacccggcggcaagccggtggagattcagattcgcacgtgggacatgcaccggcgcgccgaattcggcatcgccgcccattggaaatacaaggcgaacggtcaggcgggccgtgcgttgagcgcccccgataagtccgatctcaagcgcggggacaggaacctcgaggagaaggacaatctgcaatggatccagcagctcgccgactggacgagcgagaccccggattccagcgagttcctcggctccctcaaagacgacctcggttccgccgaggtgtacgtattcacccccaagggcaagatcgtctcgctgcctgccgatgccacaccggtcgacttcgcatacaacgtgcacaccgaggtcggtcaccgcacgatgggcgcgcgtgtgaacgggcgcttggtccccctcgacaccaagctggagaatggcgacaccgtcgaggtgctcacgtcgaaatccgacaccgccggcccgtcccgcgattggttgagcttcgtcaaaagcccgaaggcgcgcaacaagattcgccaatggttcagtaaggaacgtcgctccgagtcgatcgaggaggggcgcgacgaactcacacgtgcgatgcgcaagcgcaacctaccggtttccgcattgctcacgccggaggcgcttgtgggagtggccgacgatctcaacctgctgaatgccgacgccgtgctcgcggcgataggcgaggggcaggtgtccacgcagaatgtgatcacccatctggtcaaggacgcgggaacgaacgaagtagccgaggaggccgagcaggaactcttgccgctgcggcccacgcaggcttcgaaatcgaagggcaacaccccgggaatcgccgtcaagggcgtcaccgacgtgtgggtcaagctcgcccattgctgcatgccggtgccgggcgacaacatcatcggcttcatcacccgcaacgagggtgtctcagtacatcgcgtagattgcctgaacatgatcaacctgaggaaacgcgagccggaacgtgtcgttgacgtctcctggacgagcaacaagggtctgttcatggtgaagattcaggtggaggcgctcgatcggcctcatctgctgagcgatgtgacccgcgtgctttccgaccatggcgtcaacattctctccggcacaatcgccactggttccgatcgtgtggcaacgagccagttcagcttcgagatggccgacccggggcacctgaacacgctgctgtcggcggtgcgcaagatcgacggcgtcttcgacgtgtaccgcatcaccggtgcaaaggactccagcgagccgcgcatgcgccggatgcgcggaccattaccgtgactagtcccacggcatgcaccatatgagatgaaacgacaatgggggcggccttccacgtggaaggccgcccccattgggatgcaggtgggtcgaatcagtcgacgatctcgatgccctcgatcatgaccggctcgagcgggcgatcctgcgcatccgtggccacaccgtcaatggtggcgaccacagcgcgggaggcctcatcggcgacctcgccgaagatcgtatggtggccgttgagccacggggtcggcacggtggtaatgaagaactgcgagccattggtgccgtggatcttgccgtcggcgccgcggcgcaggccggcgttggccatggccagcagatacggcttgtcgaacttgagcgacgggtcgatctcgtcgtcgaagtcatagcccgggccgccggtgccggtgcccagcgggcaaccgccctggatcatgaaatccttgatgatgcggtggaaggtgaggccatcgtagaaggcctcatggcttggcttgccggtgaacggatcggtccactccttcttgccgctggccaggccgaggaagttctccacggtcttcggtgtctgctcgtcgaacagattgatcttgatatcaccttcggaggtgtgcatgataatagtgctcatagcctctcaccgtagcacagggcgactaacgggtgtcaggttttccgtgagcgcttaggccggttcggtttgcgcgcactataagcagattcgataacaacgcgcgtgcgttcatgacacccatgccgtatggttgaacacggtgttcgggagagggaatcttccggcagatcacacagagaacagcaacagaggaacaacagaggacaaggcaatgacttcgaacaacacgcagccaaccgctccgaacacaccggaggaaccggtacgcgtcaaccacaccacacgcaacatcgtcatcgccgtggtggtcgtggtggcgattgtgctcgccatcgtcttcggcatgcgcgcggtgaacaagaacgacgattcaccgaagggctccaagaacaacccggtggtgatcggcgtggtcggcgccaccgatccgcagtggatggagttcaccaagcaggccgagcagcagggcgtgtacgtgcagatcaaggacttccaggactacacgagcgagaatccggcactggcgcagggcgacctcgacatgaacgagttccagcatctgctctatttggccaactacaacgtgcagaacaagcaaaacctgcagccgctcggaggcgtcgccatctacccgctcggcgtctactccgcgttcgacaaggacggcaagccgaggtacaccgacatcaaggacctgccggctggctccaccgtcgccattccgaacgacgagacgaaccaggctcgtgcaatcggcgtgctcaaggccgccggcgtcgtcacgctgaaaggcgactggacggcgttcacgatcccgcaggacatcgatgaggcgaagtcgaaggtcaaggtcgtgccgatgaaggccgagcagattgccaacacgctcaaggcaggcggcgacgatctgtccgcgggcgtcatcaacaacgactatgtggcggacgcggggctcaagcccaccgatgcgatctaccaggacaacgccgaatccgaggaggcgcgcccatacatcaacatcttcgccgtgcgcgccgacgatgtgaacaacgaggtgtacaagaagtgcgtggagatctaccagacgaagccggtcctcgacgccctgcaggaggagtccggcggcaccgcggtgtttgccgacaagttctcgcagcaggagctggcgagctatctgaagcagatcgagacggatatcaagaacaagtgagccgttcatagcatggctgcagatcgctgaacacaatgagcaggttggggagagctattccccaacctgctcccatatacacgacgttcacacactcgccattgggtcgcgctaccatatgcgagtatccggccgcagtgcaggcaccggacggaacctcgacgtaaacggagaagttagagggaaatgacgcaagagaagaacgccatcatcgaattcgaccacgtgagcaaggtgtatgccgggcgtggcaagaagcagacgaaagcggtcgacgatgtcacactgtccattgacgagggcgacatctacggcatcatcggctattcgggagccggcaaatccacgctggtgcgcatgatcaacgccctcgagaatccgacaagcggcacggtgacggtgatgggccagcaggtctcgggcatgagcgagtcgaaactgcgtgcggtacgacagaagatcggcatgatcttccagcagttcaacctgttctccacgaagaccgttgcgcagaacgtggcctatccgctgcagctcgaccactggcgcaaagactatcaggacaagcgagtcaaagagctgctcgagttcgtgggcctctccgagcatgcgaacaggtatccggcacagctttccggcggccagaaacaacgtgtgggcatcgcacgcgcgctcgccacgaaccctaagatcctgctcgcagacgaggcgacgagcgccctcgaccccgagacgaccaccgaggtgcttgaattgctcaggaagatcaatgagcagctcggcgtgacgattgtgctcatcacgcaccagatgaacgtcgtgcagcagattgcccaccatgtcgcggtgatgagcggcgggcgcctcgtcgagaaaggcaccgtgtaccgggtgttcgccgcaccgcaggaggaggtgacgaagcggttcatcgccaccgccatgtcgggattgccagacgagacacgcgtcgaacagatgcatcgggattggagcggccgcctcgtcaccgtgatcgtgcgacagcacgacatcgacgacgagaatgcaaacacgcgcataccgtcctcaggacagaacatctccgagctcatctcgaagcacggcgtggcaagcaacctcatctatggcggcatcgacaccgtgcagggcgtcgcaatcggcgcaatcacctacaccttcgacgggccggaggccgaagtggagccgttccttgccgaactcgccgaaaacagcgacatcgtcgatttcggcaccgccgcggaaccggtcgactatgcgcaggcggtggagcgagcgggaattgccgcccccgagaatcgcgccgctgatgaccatgcgaatacgaacgcgcttgatttcgagcaggtggacgatgtggtcaccgtcagccgaatcaacgggcaggacaccccgggagcgcaagccgacacccgtgtcgcgtctgatgacgcgaacggtgcgcgaaaggagacgaagtgatgcatattctcgcattcgaccagacgaccctcgcctcacgcagtgactggagcgtcttgagacccctgcttggacaatccgtggtgcagacgctgcagatggtgctcatcacaatcgtcgtcggaggcttcctcggtctcattctcggtgtcatactctacggcacacgtccgggcaacctgttcgagaaccggtatgtgtaccgcattctcgacattctggtgaacatcatccgcccgatcccattcatcatcttcctcgccgccatgcagccgctcaccatcaaggtgatcggcacgtcgatcggcaccgcggcggcgattttcccgatgtgcgtgatgtgcactttcgcaacctcccgtctggtcgagcagaacctcgtgcccgtcgatccaggagtgatcgaggctgcgcgttcgatgggtgcctcgaaattcacgatcattcgcacggtgctgatcccagaagccttggcaccgctcatcctcgcctatgccttcctgttcatcggcgtgctcgacatgtcggcgatggccggctacatcggcggcggcggcctgggtaacttcgcaatcgcctatggttaccagaagttcgaccagaccgtcacctggaccgctgtgatcatcatgatcctgctcgtacaggtggtgcagtcgattgccaatgcgatcgccaagcacctgctgcgtcgcacacagaacaactgaacgatggggcgcccggatcggcgccccttttgcattgcgcccatgctgtatgggcaacacggattggactccgtgacctcgttgccgacttcgaaggagggcatatgaccgaccatactgagcatgtcgagattgcgctgaccgacgagctgctaggcattcgccgccggctccaccggcatccggaacgctcattcaaggagttcgaaacgagcatgaggctgcgcaatctgctcgaatcacacggcatcacggtgctggacaacccgcttgacaccggtgtgatcggtgagatcaagggagagcatgatggaccgcagatcggtttgcgtgccgatatcgacgcgttgcccgtgcacgaggactccggactcgtcttcgcgtccgagaacgaaggggtcatgcatgcctgcggccacgacatccatatgacatcactgctgggggcggcattctggctggcggctcatcgggagctgatccacgggaccattcgattggtgttccagccggccgaagaactcgggcagggggcgcgtgcggtggccgatgccggattggtcgacggcctcgacgcgatgatcggcacacataacaaccccgattataagcccggtcagattgccgtcggcgtggatcccatgatggcgggatgtgtgaaattccgggtgaacctgcatgcacagggcactcatgccgggtatccgcaccggggtaccgggccgcttgaggcgatggcggcgatggtcctttcactgcagaccattgtgagccgcaatgcctcgccattccatccactcgtcatctcggtgaccgaggtgcatggcggcgacgtgtggaacgtggtgccagccgaggccggattccaaggaacagcacgctacttccaccgtgaggacggcgatctggcggaacgccgattcaggcaggtcatcgaaagtacggctgccgcctacgatattgccgtggactatgtgtgggacgatttccagcgtccgctggtgagcgacccggatctggcgacgctggccatgagccatgtgccggaatacgcgcagctcgagccgattcacccatcgatggcaggggaggatttcgcggaatacgagggccacacgcgcttgttgttcgccttcataggatcgaatggctccggaggttgtgccgacctccactcaccgaagttcgttgcgcttgatgacgcggtgaaaaccggtgccgaattctatgcgaactcggcgttggaagtgctcgagcatctgagctgagtgccatgagggggcgatcgccgagggagtgtcggagcgttcccggaaaggcttcgtcactggatcgcaagcgccctttacgttcctcaaccttgccgggcgccgcctgcgcgtttgcccgccaccaatcactgatgccactgatgcatcgtgctccttccgacacgcgatgcgctgaacggtgcggttgtaacggtgacgggcctagactaggaagctatgaccaagcttcgttttgcactcgcacagatcgacacctgtgtcggcgccctcaagggcaatgccgacaaggttctggaatacgcatcacgcgccgcctcgaacaacgcacaggtggtggtgttccccgagatgacactcacgggctatcccattgaggatctcgcattgcggcgcaccttccgtcaggccgcctgggacaccgccaatgacttggcgcagcgtctggccgacgacggactcggttcgctctatgtggtcgtaggcaccgtgggcacggagcacagcacacagaagccatacaaccggcttgtcgtactgcacgacggcgtcgtatgggcgggctatgacaagcatttcctgccgaactatggtgtattcgacgaattccgaatcttcgcgtcgggcgaccgttcggtgacgatggacatcgacggcgtcaggctgggttttgcgatctgcgaggacatctggcaggagggcggtcctgtcgccgattttgccgagcggaatatcgatgtgctcgtgacgatcaatggttcgccgtacgaggagggcaaaaccgataccagactgcagctgtgccgtcgccgtgccgccgaggtcggggcaccggtgatctacgtcaaccaggtgggaggccaggacgacctcgtattcgacggaggcactttcgttgtggatgcggatggcacgttgcttgaacgctcgccgatgttcgtggaggacctgagctacatcgacatcgattccgctgcggccacccagaagccggccgacatcgcacccgagatggatcctgacggcgaagtgtacacggcctgcgtgctcggtctcaaggactacatggtgaagaacggtttcaacggagtgtgcctgggactgtcgggcggcatcgactccgctctggtggccaccatggcagccgatgccgttggcggtgagcatgtgcagggcatatccatgccgagcatgtactcgtcggaggggtcgaaggacgatgcggcccaactcgccgagaatctgggcgcctcgtacgatgtgcagccgattaaaccggaattcgatgcattccagaagcagttggatctcgagggcgtggccgccgagaatctgcaagcccgcatccgcggcgtcatcgtcatggcgtattcgaattccaaggggctgctggccctggcgacgggcaataagtctgagctcgcctgcgggtattccaccatatatggcgatgccgtcggcggatacgctccaatcaaggacgtgttcaagacaaaggtatggcagctgtcgcgttggcgcaacaaagcgctcaaggaaggtctggggctcggggcattgcccgtggtcggctacgacccgaatgcggagggcgtcgtgcccgccagcggcgagctcatcccgaacaattccatcgtgaaggcaccgagcgccgaactgcggcccgagcagaaggactccgattcgctgcctgaatactatattctcgacaaggtgctcaccgcctatatagaacattcggaagggcgggccgatctgctcgcccatgcggatttcgacgagcagacggtcgacaccgtcatgcgtctcgtcgaccgtgccgaatggaagcgtcgccagtatccgttggggccgaaggtgagcgcgctcgcatttggccgcgaccgccgtctgccggtcaccgacgcattccgcgaataaccgcgtagctataccccatgatgtgagacaaggagaatgacatgacagaaccgcaggagtggtactacaatacggtgaccggtgaagtggagctcggcccacagtccccgatgcagaaccgtctcggaccgtatgcgacgcgtgaggacgccgagaaggcgctcgagatcgccaagaagcgcaacaagaaatgggaggaccaggacagggactggaataattggggaacggacaagaagtagtctgaatgtgtatattatgtgcatacccactttggcgggcggccatccggaatggagggcgcccgccttgtgttgtgcagaatgtgggcgatgcacaagtggaaatgtgaccaagctcacgcgtttgccgctggtcgcggcacagcgatttgaagtactatggattttgttagagatgcggcacaaagtggcgtcgtatacaagctacacccagaaggagtggcaatgtcagcaattgaaaacgtggccgaggtgtccccggaagccatcaaggaacaggcttgggaggggttcgttcccggcaactgggagaaggacatcgacgttcgtgacttcattcagaagaactacacgccttacgagggtgatgaatcgttcctcgcggatgcgaccgacaagacgaagtacctgtggaagtacctcgacgacaactatctggcggtggagcgcaagcagcgtgtctatgatgtggacacccacacgccggcggatatcgacgccttcccggctggctatatcgattccccggagatcgacaatgtgatcgtcggcctgcagaccgatgagccatgcaagcgagccatgatgccgaatggcggttggcgcatggtggagcaggccatcaaggaggccggcaaggagccggacccggcgatcaagaagatcttcaccaagtaccgcaagacgcataacgacggtgtgttcggcgtctatacgaagaacatcaaagtggcacgccacaacaagattctcaccggcctgccggatgcctacggccgcggccgcatcatcggcgactaccgtcgtgtggccctgtatggcgtggatgcgctgattaagttcaagcagcgtgacaaggacgccatcccgtaccgcaacgacttctcggagaccgagatcgagcactggatccgttaccgcgaggagcacgacgagcagattaaggctctgaagaagctcatcaacctaggcaaggaatacggactcgatttggcgcgccccgccatgaacgcgcgtgaggccgtgcagtggacctacatgggctacctcgcctccatcaagagccaggacggcgccgcgatgagcttcggccgcgtgtcagcgttcttcgacatctacttcgagcgcgatctcaaggaaggcaagatcaccgagaccgacgcccaggagatcatcgacaatctggtgatgaagctgcgcatcgtgcgattcctgcgcaccaaggactacgattcgatcttctcgggcgacccctactgggcgacatggtcggatgcaggcttcggcgacgatggccgcaccatggtcaccaagacgtcgttccgtctgctcaacacgctcacgctcgagcatttgggaccgggacccgaaccgaacatcacgattttctgggatccgaagctgccggaaggctacaagcgtttctgcgcccagatctccattgatacctcggccatccagtatgaatccgacaaggagatccgcaaccattggggtgacgatgcggccattgcatgctgcgtctccccgatgcgtgtgggcaagcaaatgcagttcttcgcggctcgcgtgaactccgccaaggcgctgctctacgcgatcaacggcggccgtgacgagatgaccggcatgcaggtgatcgacaagggcatcatcgagccgatccagcccgaggctgacggcacgctcgattacgagaaggtgaaggccaactatgagaaggccctcgaatggctttcggagacctacgtcgaagcgctgaacatcattcattacatgcatgacaagtatgcgtatgagtccatcgagatggcgctgcacgaccgcgaggtctaccgcaccctgggctgcggcatgtccggcctgtcgatcgccgccgattcgctttccgcatgcaagtacgccaaggtgtacccaatctacaacaaggacgccaaggacatgccgggtcacgagtacgaatatgtcgaaggcgcggacgacgatctggtggtcggctaccgcaccgagggcgagttcccgctttacggcaacgacgacgatcgtgccgatgacattgccaagtgggtcgtgtccaccgtcatgggccaggtcaagcgcctgccggtgtatcgtggtgccgtccccacgcagtcgatcctcacgatcacctcgaacgtcgagtatggcaagaacaccggatccttcccgtcgggccacgccaagggaacgccgtacgccccgggcgcgaacccggagaacggcatggactcccatggcatgctcccctcgatgttctcggtgggcaagatcgattacaacgacgcccttgacggcatctcgctgacgaacacgatcacacccgacggcctgggccgcgatgaggacgaacgcatcagcaacctcgtcggcatcctcgacgcaggcaacggccatggactgtaccatgcgaacatcaacgtgctgcgcaaggaacagctcgaagacgccgtggagcacccggagaagtacccgcacctgaccgtgcgcgtctccggttacgccgtgaacttcgtcaagcttacgaaggaacagcagcttgacgtcatttcccgcaccttccatcagggcgcggtcgaggactaaggcacgcgagaggcgattttatcgccggtaggggcggggcttttcggccccgcccctttgcattcggctatagtgatactggaggtagccatgtcgaattcagagtcgaatcacggtgcatccgcattccgcaccacgacgcggcacatgctcaagtcgtcgaaggagtaccagcgcaagacgctcatgggcggtctgtcaggattcgaatcgcccatcggactcgatcggcgtgaccgcatcaatgcgttgaaaaccggcgacataggttttgtgcattcctgggacatcaatacgtcggtggacggcccgggcacccgcatgacggtattcctgagcggctgcccactgcgctgccagtactgccagaaccccgacacctggaagatgcgcgacggcaagccggtgtacctcgatgccatggtggtcaagatcgaacggtacaaggacctgttcgaagccacgaaaggcggcatcaccttctcgggcggcgagtccatgatgcagccggcattcgtgtcgcgggtgttccgggcggccaaggagatgggtgtgcacacctgccttgatacttcgggcttcctcaacgccaactattcggatgaaatgatcgacgacatcgatctgtgcctgctcgatgtgaagtccggagacgaggagacctacaagcgggtaaccgggggagtgctccagcccaccatcgatttcggacagcggttgaacaggaggggcaagaagatctgggtgcgcttcgtgctggttcccgggctcacctcgtcggaggagaacgtggagaatgtggcccgcatctgtgagagcttcggcgacgcggtggagcatatagacgtgctgccgttccaccagctcgggcgtccgaagtggcatgagctgcgaatcccttacccgttggaggaccagaagggaccttcccaggcgttgcgcgaccgcgtgcgccagcagttcgagagccacggattcacggtctacgtctaagcgacggcgaatgcgccgacacatgatccctgacaccggtgtcagcgcattcgttatatttgacggttgaaggcaaaccgtgcatcaggagggacctgcgttggattcggtgaacaaggaaccggtgttgcagaccgagccgaaggaaggggttcccgaagtcaccgacaccttggctggcttcgaactcatctgcgaacaatacgcagcggtgaacaccccactggccaccgatgccgaaagggccagtgggtaccggtacggccacgaggactggctcatccaattcaaacgcgacggtgcaccgatagcgctgctcgatccgatcgccctcgatgaacagggtgtggattggaatgcgttcaatgaggctgtgggcgacgcggaatggattctgcacgattcacgtcaggacctccccggattcgcccagattggcctgaagccgcgccggctgttcgataccgagatcgccgccaagctattggggctgcatcgggtcggcctcgcctatgtgacggcgcatttccttggcatcacgctggccaaggagcattcggcagccgattggtcataccgcccgttgcctcgcgattggcgcaactatgccgcactcgacgtcgaattgctctccgatctcgagcgggcaatgacgcatgagctgaaacggcagggcaagtgggaatgggcgcaggaggagttcgattatgccctgcacgagggattgcagcctcccaaaccgcatccggtgccgtggatgcgcatatcgcatatcaatgtgctgcaacgcgaccgtcgaggactcgccgtggccaaggcgctatggaccgaacgggaccgactcgcccgcgaatatgacatctcgccatcgttgctgttggcggattccgcgatcatcgaagcggcacagaggaagccgcacaatgccagtcagttccgtgcagtgcgctcgctcaacgaacgggtgcgcatgcatctgggcaacgagcaggacaagatgttcgaacgctatgcgcccatccagcgcaaagtcaagccgtcgctatggaaacggacaatccaggaggcgctggacctgccttccgacgagcttcccgagcttcccggcaaagcggctggtcacggtgaggacgtggtgaatgcgccacggtctgcgaaattctggcagacccatgagcccaaacggtaccggcagctccagaggtgcaaggccgtgctgaaccagatctcgcaggacacctgcacccctaccgacgtgctgctcaagccgcagatcctgcgcaacctatgctggacggaccatccacatcgtcgtgatgtggcccaattccttgcgcaacaaggcgccagaccatggcaggtcgacttgctcagcgagtcgctgtcccgcgctatcatgtaacggttgcccaaggggcagttgatataccaatagaacagaactttcaggagcgcaagcgtgaaaatcagcgtaaggaatcttgagccgaccaaggctaagctcaccatcaccgtcgaccaggatgagttcgatccgtacctcgaagatgctcgcaaggaaatcgccgagcagattaccgttccgggcttccgcaaaggccatgtgccaggcaagctcgtcgaccagcgcgtcggcttcggtgccgttgcgggtgaggccgtgaacaaggcattgccggatatgtatgccaaggccctggacgagaaggacatccgtccgatggaccagccgcagatcgaggtcgtggagatgccgcagagcgccgcagacgacaccaagctcaagttcaccgccacggtcgagcgtcgtccggagttcgagctgccgaatctcgagggcctcgagatcgcagtggacaaggccgaggtgagcgatgacgatgtgaacaaccgcctcgggaccctccgccagcgtttcgccaccctcgtgggtgtcgaccgtccggcacagaagggtgacttcgccaacatcgacctgaccgcacagaccgacggcgagaccgtggactcccaggagggcgtgagctacgagatcggttcgggcaccatgctcgacggactcgacgaggcgctcgaaggcctgtcggccggtgaggagaccaccttcgaaagcacgctggaaggcggcgaccatgagggcgagaaggcccaggtgaaggtcaaggtcaactccgtcaaggccgaggagcttcccgagcttgacgacgacttcgcccaggaggcctccgagttcgacacgctcgacgagctcaaggccgagattcgcaagaacatcgaggccgatgcggagggccgtcaggccacgatcgcacgtgatgcgttcatcgagacccttgaggaaggccttgacattccgctgccgaagggtgtgcgcaacaacatggtcgagcagcagctcaagtcgatgggcgtcgaggccggcaaggcgacctccgatcagaagaaggaggccgaggaggccgtcgacaagatgctcaaggaccagatggtgctcgatgcccttgccgagaagctcgacgtgcaggtctcccagtccgatgtgttcaacttcctcggctcgattgcccagcagtacggcatggatccgaacatgttcatccaggccctcatgcgtaacggccagatcggctccgccgtcgaggaggtggcccgttccaagggcatgctcgccggcatgcgtcaggtgaagttcaccgttgacggcgaaccgcttgatctgagtggcttcctcggttccgaagaggccgaggcacaggccgaagaggatgagtcagttgccgcagcggctgcagcggccgccgtcgccgacaacctcacctcggacgacggcaccgacgccgagtgatctcattttccttcaagacccctgccctcggcgggggtcttcccatatccgaacgtctttggagcgcccccgatatgtccactccgagtgaacaagattcgcctctttcctccttcgcccagcccccatgcgcggaaagcgggggacatttcgacaacgatttcgcgacgatggcgaacacacgtgccgatgccaccggtgaaggccgaccgccggtggtctcccgcgctttctcgttgctcgtctccacactggtgctcggtgcactcataggcatctgcgcggggctgctcacattgctgctctatgccatcgaacacctgtgcctgggcttcgtggagcatccggaactgcccggcccctttctgacgccggcatggaggcgtgcggcatcggtgttcggcggcgcatcggtcgccgccatcgcatggtgggccctgcgcacgaaatcgaaggcggtcccgtcggtcaaacaggcggtggcaggcagactcatgcctatctggcagaccgttgcccatgtgctgctgcagatcttcatcgtcggcaccggtctgtcggtgggccgagaggtggcgccgcgcgaactcggtgccatgctcgcgcagcgatgcgcacgcatgctgcggctgaatccgaccgacatgcgcacaatcgtcgccgtgaccgccggggccggtcttgccggtgtctacaacgccccgcttgcgggtgcgttcttcgccgtggagattctgctcgtcgatgtcagcggtggcaccgtgatcctctccttcctctgctccacgctggcggcctgggtggccaccctcgtcaaaggcacgcacacgttctacgtgatcgggcatgtggatgcgcacttctcgtgggatctcatggttttcgccatacccgccggggtgattctgggcgtttgcggcgcgttgttccgcaaagggtcgcagtgggccgagaggaacaaggcggccggcaatgcgattctatggatgctgccgctcgccggtgcagtgaccggcatcgtggcgattcggattccgcaggtgatgggcaacggccgcgccaccgcccagctggcattctcgggcacgccgacgatgtcgctgatcccattgttgttgctgtcattcgccgccaaggcgctcatcacactgttcacgattcgcgcgggcgcctccggcggcgtgctcacgccgggcatcgcactcggcgcatcgatgggatgcatcctcgggatcctgtggatgcagatgaccggcacgaactcaatcggcgtctacgcgctgctcggcgcctgcgccctgctctccgcctcgcagaacgccccgctcatggcgatgtgcctggtgatggagctcaccgaggcgccgatgaacctgttcgtgccggtggtgtttatttccatgatctctttgctcgcctcgcacgcgacgctgagtgtggtggaacgccggtcggtgactgtgctcggctgacgcgcgaatctgttcgccgtattcggcagacggggaatagattgccgggagagctggtttgtacacataggaaaatctgcaaagattaaggagacaacgtgagtgatttgatcacgtcccctcgcatggctggtgaagacatgccggcgggtccggccgatccgattttcaatcgactgctcaaggaccgcatcatctggctgggtgaggaggtcaaggacgatatggcgaaccgcatctgcgcacagatgctcatgctcgccgccgaagatccaaagagcgacatctggctgtacatcaactcgccgggtggctcgatcaccgcgggcatggccatctacgacacgatgcagctcatcgaaccggatgtggccacggtgggcatcggcatgtgcgcttcgatgggccagttcctgctgagttcgggcacgaagggcaagcgtttcctcacctcgcacgcccgcgtgctcatgcaccagccgtccggcggcatcggcggcacgaccaccgacgtgcgcatcaacgccgaactcatcatggacatgaagaagaccctcggcgagctgaccgcggaacagaccggccacacgatcgaggagatctaccgcgacaacgaatacgaccactggttcaccgccgaggaggcgttggagtacggcttcgtggacaagctcgtctccacgcacgagacgatgaacagcgataaggagtaagcatggcatccgaagaagcacagttcgtcgccagggccgagcgtctcgcaggccctgcaggcattgccggtttccagcccgcggccgcgcgtgaccgagccctggccgcgcagaaccggtacgtggtgccggagttcactgagcgcacgccttacggcatgaagacacagaacccctacacccgtctattcgacgaccgcatcatcttcctgggcgtgcaggtggacgacacgtccgccgacgacatcatggcccaactcctcgtgctggagagcatggatccgaatcgcgacgtgatgatgtacatcaattcgccgggcggttcgatgacggccatgactgccatctatgacacgatgcagtacatcaaacccgatgtgcagaccgtgtgcctcggccaggcggcatccgcggcggcgatcattctggcggcgggtacgaagggcaagcgtctcatgctgccgaacgcccgcgtgctcatccaccagcctgcaatcgaccagggcttcggcaaggccaccgacatcgagatccaggccaaggagatgatgcgtatgcgcgaatggctcgagaacacgcttgccaagcataccggccagagccgtgaacgcatctcccgcgacatcgaggtcgacacgttcctcaccgcttcggaggcgaaggaatacggcatcgtcgacgaggtgctcgagcaccgctcctgacgcagcctgacgaatgcggtaatctgcgatctgttctagaatgacgggtgcgtgcccagtgcacgtgcccgtttttgtatgcatgcggaatgagggtgaatatgggacgtgtggtcagctataacgacggcgtgcagcgctgcacgttctgcggcaaaagcgagcatgaggtacaccgtctggtggccggtgccggcgtggcgatctgcgacgaatgtattggcctctgcgtgcagatcctgagcgaggagaacgccaaggactcgcgtcttgaggtgttgaaactgccgaagccctcgcagattcgcgatgtgctcgaccaatacgtgatcgggcagaacgacgccaagcgcacactcagcgtggcggtctacaaccatttcaaacgcgcgcagattgaacgccacgatgccaatgcacaccgccagttcgagcagtccaggcttgcggattcgacacgttcgattctcgatccgctcgacgaggtgagtgtggcgaagtcgaacatactattgcttggaccgaccggcgtgggcaagacctacctggcgcagacattggcgaaggcgatgcaggtgcccttcatcatcgtcgacgccacctccatcaccgaggcgggctatgtgggcgatgacgtcgagatggtgctgtcacgtctgctgcaggcggctgacggcgacgtggaccgtgcgcgacacggtatcgtctacatcgacgaggtagacaagatcgcgcgcaagagcggcgacaacacgtcgatgacccgcgacgtctccggcgagggcgtgcagcaggcactgctcaagattctcgaaggaacgctcgtacatgtgccggtcgacggcgcacataggcacaaggacggcgagacggtggaactcgacaccagcgacatcctgttcatatgcggaggcgccttcgtggggctcgacgagatcgtctcgcgcaggctgggtcggcatgaaagcggtttcggggcgtcgtggcgcgtgaatccgatcgacgaacacgagatatacagacaggtgaatgccgacgatttggcggagttcggcctgcttcccgaattcatagggcgcctgccggtggtgtgcacgctgggagaactcacggtggacgatctgaaggacgtactcaccaaacccacgaacgcgctgctcaagcaataccagaaactgttctcagtcgatggggtcacgctcacgttcaccgacgccgccgtcgaagccatcgccagcaccgcactggagcggggagtgggtgcccgagggcttcgttcgatcatcgaatcgattctcgaggagacgatgttcgaattgccgaacatggacgatgtgaccgaagtggtggtgaatgccgattgcgtgacggagggcgtgcctccgcagatggtccggcccgagcggcgacgtgtgatccatgccctgtgaatgccgtcatcttcacgatttcgacacgccgaagttgtgattgaccatgaaacgttgtatgttagtcgagttgcctgaagcaagcaattgcgcgagtagcccagcggattagagcagctgactacggatcagcaggtcgcaggttcgaatcctgtctcgcgcacttggctatgtgaactgtgtgcaaatgcatgcgattcaggtagcatgcgcgagtagcccagcggattagagcagctgactacggatcagcaggtcgcaggttcgaatcctgtctcgcgcacaacaagcccttgaacgtgcatacgctcaagggcttttccaattgcatgcggcgcgatgttggccgtaacccattcgtgaactgtggtgttgccgccgtaacatggcgacgttaagctgacccaccgtatgagagaacagaccgcagcgacggagggaaagggaatatgtacgatttcgaaacctggccagagcggcacgacacaacttcggtgaaatggaagatgatcgagaccgagctgggtgtcggtcatgaggatgtgctggcgttgtcggtggcggatatggagttcgtcacgccgccggccgtcgtcgaggcgcttgtggatgctgctcgcaatgatgtattcgggtatgactatgccaccgacgagtacttggccgccgtgtgcgactggatgcgccgccgccatggtcttgaggccgatccgaagctcatctcgctttcggcgggcgtgatgccggcggtgaacacggcgttgcgtgcgttcacccatccgggcgatgcggtgatcatccagcgacctgtgtactacccgttcacgaacgcggccatgaacaatggtctggagatcctcaacaacgccctgctgtttgatggggagaccggtcggtattcgatggatttcgaggatctggaacgcaaggcctccgacccgcgctgcaaggcgatcatgctgtgcaatccgcacaacccggtgggccgtgtgtggacggccgaggagctgcgtatgctcggcgacatctgcgtggccaacgatgtgatgattctatgcgatgagatccatggcgatcttgaacaccccgggcacgccgtgacgatgttcggcacgttgggggagcggtatgcagaccatctcatcgagttcaccgcaccgtcgaaatcattcaacctggcgggtctgctgtgctcgaacgcgatcttccacaatgccaaggtgaagcaggagttcgacatcgccgcggcgaaaaccggcggcagcacggtgaatcatctgggcatggtggcatgcatggccgcctatgcccgctgcgaggactggttcgaggagatgctcgcggtggtgcggcgtaatctcgacaccgtacgtgccttcgccgacacccacgacggcatacggctcatcgagccggagggaacctatctggcatggctggattgccgcgggctgggcctttcgaatgatgagctggagacgttcatgcacgaacaggcgaggctctatttcgacgaaggatatctgttcggccaggagggcagtggtttcgaacgcatcaacctcgcttgccctgtgcgcgtgatcgagcggatgtgcaggcagctagacgcagcgctttgcaagctgggagtgggacccgtggccgcggattttgcggattgtgtatgagcgggggcgtcccattgggcgtatggcgggtgaatgcggcataatggatagctggatattggcataggagtacagcgagggcggcatgagcaacaggcagcgtggagtgtgggcatcgattcggaaagtggcggcatccgaccgcatatcaggtctcatcatgctcggattcgcgttgctcggtctggtgctggcgaatctgccggcgacctaccactggttcgaagagctttcgcatttccatctgggcattccgggaaccaacattgacatggggttgggccattgggctcaggacggcctgctgacgatcttcttcctggtcgtcgggctcgagctgcgtcaggaactcaccaccggctcgttgtcgaatgtacgcgcggccgcggtgccgatgctctgtgcggtgggcggcatgttggtgccgccggtgctgttcgttgccgtcatctcactgttctcgaacttcggtgccggagatccgggcagcctcatcatcgcgaacggttcgatgttcagttttgccgagacggcacacggatgggcgattcccacggccacggacatcgcattctcgctggcggtgctcgcgctgttcgccaaggcgttgcctggctcgatccgtgccttcctgatgacgctcgccacggtggacgatctgttggcgatcattctgatcgccgtgttcttctcgtcgctcaacgcctggtactggtttgtgggcattgcgatctgcgcggttgcctggtacttcctggtgcgcatgaagaaggtgccatggttcggcgtggccgtcataggcattctggcttgggtgatgatgtacgaggccggcgtgcacccgacattggccggcgtgctcgtgggattgctcacgcctgcacgtgccatgtacggcgaacgttcgccgcgtgccgaacggtatgccgacaagctgcagccgttctcggcgttgctggcattgcccatcttcgccttcttcgccactggtgtgcacttcgattcgatcaccccaatgttgctggtctctccggtggtcatcgccatcatcgtggcgctgttcgtgggcaagccgctcggcatcatggccaccgcatggctgtccacccacatcggcccgtttgcgatgcccaagggactgcgcgtgcgcgacatgttcccggcttcaatcgcctgcggcattggcttcaccgtctccttcctcatcgcatcgctggcgtatgcgaacgctgagctttccgcggaggccagattcggcgtgcttctggggtcgctggtggcggctgcggtgtcggcggtgctgctgagccggcagtcggccagattcgcccgcatggactccgtcgaggagcgtttggccgcgatggaacgccccctcgaggccacgcgcacgctccgggatggcaccgttgtggtctcccagaccatgggtagggatgccgagcaggatctggcgcaactcaaggaagaagactcccgcagctgaggtggccatgttacatggccggggtctgcactcgctacactcgcagttggaaatacaccacagaatcgaaggagtggcatgcaatccaacaatgaggagaatgcgaatggcgggcagacgatgaatcatgcggaggagccgctcggacggacctattcgcagggaccggtgttgttgcgcggcaagatgattccaagtgaaagcacttcggaacgcttcctgcgcaatgattccgacacggattggctgcatcgcgacccatggcgtgtactgcgcattcaggccgaattcgtggatggcttcggatcgctggccgagctcggtcctgccgtgagcatcttcggttccgcacgtgtcgagcccaatacgaaggactacaaggccgccgtcgcaatgggcgcgaagatcgccgagcgagacattgccgtcatcacgggaggcggcccgggcatcatggaagcggcgaacaagggtgctgccaaggccgggggcaaatcggtgggtctgggaatcgaattgccgcatgaacaggggctcaacaagtggatcaacctcggcatgacgttccgctacttcttcgtgcgcaagacgatgttcatgaagtactcgtctggcgtgattgtttgccccggcggcttcggcacgttggacgagaccttcgaggcgctcacgttggtacagacgcagaaggtggcgaaaatgccgattgtgctcttcgattccgcatactggcgagggctgttcgattggattgacgggccggtgcgtgaacggggcatgatctcgaacatcgatcccgatctggtgacgatcaccgacgacatcgacgaggccgtcgatgtcgccaccagcatggttcccaggcagaccggtgcgcactgatccgtatggcatggtggtgcgaatcacgggaatccaattccgatccgctccaccatgccgaattattgcaatgtggcgatgagcataccccagccggtctgggagagtgcggagatgaagcggtcgtcatcggtcacggcgtcgatgagttcgcgcatggccacggccttgtcgccgcgatccgccgggttggtgagaccgcctttggaatccggcgattccatggccaacacatcggtgaaaatgatcacgccatgtctgcgcagcaatcgcggtgcctgctcgtaggcggcagggtagttcgaggcatcgccgcatacaacgatgagatcgtagtcgtcgccgttgagacgcgacaagaattgggttggatctgcgttgacggtgcgcagcgtggcccgggtcatcgtggcggcggtgcggaatagtctcttgatctggctatgaccttgaggtgtggagtcgacggcagtgagtttgtcgtcgtcattgagtgaacaagcgattcgagccgtctgtaccaatgatccggtgccgatcacaatgaccgacgatgcgccggacatcgtcttgaacatgctgagcatggcgccttcgcatgcggagaccgacgggtcgttgtcttcctgcatcagcgtgcgcgcctcatgcacaaggtcgggttcaagcgcgaattcgcgggtttcaatccaatcccatgcccgcgcatggttttcgaatgacgttctgtccatattcattcttccttaccgctctttcacctgcgcaatgagttgccagatctcctcgcccacgtcaatgccgcgggggcactgcctagagcatgcccgcaccgactggcaggcctgcacgccatcggcggtgtcaagggcctcaaggcgttcctcggttgcagtgtcacgcgaatcgttgatgaatcgcgcctgattgatgagcgccgccgggccgatgaacgcctcgccgccggcatagaccgggcacgccccctcgcacacgccgcaggcgatgcagttgctgagcaattcatacttggccagttcctgtggattctgcagatactccagcacatccaccttgccgtcctcacgggtcttgatggcattgtggtgaatgaggtagggtttgagacggcgaatctgttcgagcatcgaatcgatgtcggcgacaagatcgcgcttgaccgggaaaccgggaagtgcggcgagttcgatgacacccagatgatccccctcgtcgatctgatgtgcgagatcctcctcgaatacgttggcgttgtctgcgtcgtcgacatcgccggtacggcggaatccctcgtcgtcggggtaggagatgttgggtagccgctgcacccaatcctgcacttgtgccgtgcacagcaacgtgggtgtgccgttgacggcgacggcatccgaaccgcacatgccatggccgcaggaatagcggaatgccagtgtcgggtcgatatcgcgtttgatggtgagcagacagtcaagcaacgtgtcttcaggacgcacgagcaactcgtattcctgcacccaggatttgccgcgtggcctgccggcgcgtgcggaatccgcgaacggcgagccgccgcgcctgccgaacggacttgacgaatgtcggcgctcccgttcgggacgcggggtgaagcggtgcacacgcaatgtcaccgtcgcttggatgacggaggatggggagctcatgcaatgcctttccacagtgtcgaatactgtctcatattgtatatgcgcgcgcatgcaaaagccgtgaccggtgcaacattcacacggttgcgccggtcacggctggaatcagtacgagcgcgagcctggttcgatgtctacgatgttcaccggcgcccagctgacgtcgccgttgaggttcacgaatgaatgcctgagatattcggcatcgttacgctcggggaaatcgctgcgatagagcgagccgcgggactcctcacgggcgcgtgtggccgtgagcatggccagcgcgagttcgcagagatgatgcgcctcgagaatcgcggtgatctcctggttgaacactttggaatcgctatgggcatgcagtagctcagaacgtggaatgaggtcgtttcgtaatgcggccattgccttgtcgagcaaagtggcgtcggtgaccacggctgcatgcgcctccatgaaggtgccgagatcggcgatgagcgcataggcgttgtcgctctgggacgttccctctgcagagtcagcggattcgagcagtgtgtcgatgatgcctttgcgtcgattcgacgcatcgacgagttcctgcgcaagggcgtgcgtgtcaccttccacatccgatgcggcaaccggatcggatgccactcgggtggcgatggagcgtccggcgcgagtgccgaacagacatgcgtcgagcagggagtttcctccaaggcgattggctccatgcacgctgacgcacgagcattcgcccgccgcatacattcccgttataatctgacgcccgtcggctgtgggaatgtagacttcgccatcgacggtgattggaatgccgcccatcgtgtaatgcgcggtcggtttgaccggcacgaggtccgtggcgggatcgagcccggcataatcccggatcgtttcgaccacctgtggcagcacctcatgcattcgggtggcgtcgatgccggtcatatcgagccatacacagtccttgggcccttccggatccttcgggtcggcgacgccccgcccggccataacctcgctgcgaatggcccttgaaaccacatcacgcgcggccaggtccttgtgctcgggcgcatagtgttccatgaatgcctctcccgtggcattgcgcaatacgccaccttcggccctcgaggcctccgagagaaggattccggtgtgcgccagaccagtgggatggaactgcaggaactcggtgtcttcgagatcaagacccgcctgcaaggccaatgccatgccatcgccagtgagatcgtgggaattcgacgtcgtatggaacaggcgtccggcaccgccggtcgccatgagcacgttgcgcgcggcgatggcatgggtcgtgccggtggcgacgtcgtaggcgaccacaccttcgctggccgtatgatcggcgttgagtacaagatcggtcacgtaccattcctcagcgaatgcaacgccctgtgccacgcattgctgccagagggcgaacagaatctggtggcccacccggtcggcggcataggcggcacgtttgaccggggctttgccgaagtcgctggtatggcctccgaaacgccgttgggcgattcttccatcctcggtacgggagaaggcgactccgtcatgctccaggtcacgtacggtgtgggcggcctccttggccaacaacttggcggcatcctgatcgacgagccaatcgccgcctttcacggtgtcgtagtaatgccattgccattcgtcgggttccatgtcgccgaggctggcggctatgccgccttcggcggatccggtatgcgatcgcaggggttgcaacttggaaatcaccaacaccttgggctcgatgccccgatccctgagatcagcgacctcctggctgcggtagaatcccagcgctgcggacagaccggccccgcccgcacccacgatcaccgcatcatacatgtcttcaaccttggttggactcatacctcgattctgccatagggcctgacgtttatggtctgatgctcggtgcatgggtctcatggcacagttgctcgatgtccgaggtgctggagagcaacgacgcctgctggtcggcgatgagcctgttgcacccggcatgcgcgggtgtcgtgatctcgcccggcactgcgaagagcctgcggttcatctcgttcgcccagcctgccgtattgagcgctccggagcgcagccgggcctgtgcgaccacgaccgaataggccagtgccgcgatcagccgattgcgcagcaggaaccgacgtggctccggtatcgtgctcggggtgcattccgacaccaaggctccatgctgggcgcagatctgctcgaagagccgcatattcgtggtggggccacaatggtcgagtccgccggcgaatatcgccacggttcttccggctactttggctccgagctgattcatggcctcgagcgctccccaatgcgccgcggcatcgatgcccatggcaccgccggaaacgacgagatggccattcaaggccgtctggcaggccaggttcctcgcaacgtgacgcccatattcattcacgccacgcgaacccactatggacaccgggcgatcacatgatgtgagggccgttgcgtcgccctgcacccacaaggcaagtggaggcgcccaatcagagcgcacgtcgaggtcctccaacgactctggccagtagggcgaaccgggaatgacaacggtataggcgccttgtccggtgaacagtgcgcatagcgcatccgggtcgaaggtcggcagctgcagcaggcggccgatccaccgttgtgaggccagctggaaggatgccacgccttcgctgcgcgccttgcggccccagcgtgccgtgcccagaatgaacatgcattccaaggtgttgcgtgcgcgtcgttgctcctgttcggtggtggcgcatgcaaccatgagcagcgcgcgcagtgcctccacacctggatgttcgctgtcgcatcccttcagcaacgaggtcatgagcgcattggcgcattcgctgcagtgggtcagcaacatgcgggcgagcgcttcgtcgtcagactgcagcagcgccttggcgctcaacgtgggttgtgcgggtgccgtgtgtgattgtgacgtggtctgatgggtgagggcggtcatgtcttctccgtttcaaggtggggccgggtaggttcagttgacttcagtggtgcgcaacgagagcgcgcggtcgacatcgtcaaggttcggacttgtacgtccatcgagatcgcagatggtccatgagagcttcatcacgcggtaggcccctcgcagactgatctgataggaggagagcgcctggttcaccacggcgagcacacggtggggagtgtgctcacgtaaccacgaccctgcagcttgggcattgcttgtccagccgaatgatcggaatcgctccaccgccatggaccgtgcagcgatgacctgctggcggatgcgctcgctgctgtcgccttccggcaactgccgggaccctatgtgggaaacggggcatacctgcagctgcatgtcgacgcggtcgagaatggggccggagagtcggctgaaataccgtatgcggtcgcgttccctgcaggtgcagcgttcgccggtgccatacccatagccgcaggggcatgggttcgccgccatgatgagttggaattgtgcggggaagattgtggttcccctggaccgtgacacggcgacatacccagcctccaatggttccctgagcgattgcagcacgcgtggtgcgaattcaggcgcctcgtcgaggaacagaaccccatggtgggcgcgtgtcaccgatcccggttctcccaggccggtgcctcctcccaccaatgaggcgacggaggcggtgtggtgcggagcctcgaatggcggcatgctgtcgatgccgtgggtgcccagctggccgcagagcgaacgaatggatgccacttcgaattgctgttgttggttcagcggggcgagtatgccggggaagcgtgaggcgagcatggttttgcccatgccgggtggcccggtcatgagcacatggtgtcctccggctgctgcgatcttcagcgcctccttcgcgtcgtgctggcccaccacttcgttcatgtcgccgacaggcagcagattgccctccggcaggtcgcgtcttcgggtgtccacatgaatctcatggaccgtgtagttggcacgacctccgaacaattcgatgagttcacccagatgcgagacgtacatgacatccaagccgtcaatcagttcagcctcatcgcggttggcacggggaaccacgacgcggttcatgccatgctccttcatatgcagcatgattggcagcaggccgttgatgggcagcaccgtgccatcgaggttgagctcgccgagtagcacagtgttgtccaacgcgtcgggctctatgaattccgaggcgctgagcacactggcggcgatggcaagatcgtgtgaagaacctcgtttgggcatcgaggccggcgacatgttgacggtcacccgggtctggggccatttgaagccgcttgcggtgcatgccgatttcacgcgctctctggcctcgctcagcgacgcgtcgggcagcccgatgatggagaagaacggcaggccaggagagatgaatgcctgcaactgaatcatgaaggccttgagccccaccagcccgactgacaatgctgttcccagagccatcagaacgcctccggcacatgatgaatgaagacgtcggtgggtgtgacggtgacggcgatgacatcgaaacgcactccgatgtggcgtatggtcgatccatgctcaccgagccagcatattgcggcccgacgaacacgcatctgtttggcagcatgcactgcctcctcggggatgccgcatgatgtggatctacgcgtcttgacctcgacgaatacgatggtgctgtgcgaggtaagcgcgatgatgtcgatctcgccgaaccggcagtgccagttgcaggccaacacgtgccaatgatgttcgatcagccatgcccggcaaagccgctctcccagggagccgatctgcttggcggtgaggtccggggccaagagcatggccttgcattgctcgaaggtatccgcgtccacgactgtctgcgtgggtatggtcgccagtgtcggcgatgtgctgttgtgctgtgatgtaatgtccatgctccaagtccagcaacatcgcggcacgcatgcaaccggctttgaagatttgtggataacccggcttgcattggtgtcgaatgtggacacccaagcggttattcacattcgggatgtccactgtgcgtgtcggcattggaatacgcattcgccccgcattttcatgcggggcgaatgcgtcagatccacgacctgctcaatccacgaggctggtcaaatctcccaggctcagttcgaaactcacgccacgatcctgatagtcgggctggaacttcgtctggaccatcgcgttgtgcacgaattcgccggcaagtctggaggccgctgcaaggtcgagtccggccatcacgcccccgatcatggcggaggcgaacgcgtcgccggtgccatggcacatgtagggcagtttctcgtgcacgcattcggtcatccggtccacgccctccttggcattggccacgaagttgcgaattcggccgtcattgtggtcgatgcccttgagcacgacgttcttggcgcccatatcgaacagattgccaatgatctgcctgacctgctcgttcgtgatgtcctgtccggggtactcagtgccggtgagaatggaggattcggtcaggttcggcatgagcaggtccgcgccatcgacgagcgcgcccatcgcctcgcaaagctgtgccgtgtacgtggcatacatctcaccggcatcgcccattaccgggtcgacaaaacgcagcgacttggggtactcgcgatacagtcgctgtatgatcgccacctgatcgggggagccgaggaatccggagtagacgccatcgagctcaacgccctcctgctgccaggcgtcgaggtatccgcccagcatgtcggtggtgtcttccatggtgaacaccttgtagcgagtatgcgccgagaacagagcggtcggcaccgggcagacatcgcatccggcagccgagaggatcgggatggcggcggtgagcgagcatttgccgtacccgcacatgtcatgcaccgctgcgatgcgtggaatatattcgcgattgcgttcgtaaagcacttctggcatattgctccttgcagtcatcgaccatatatgcctcatacaataggtgaacgatatgccaagcgcattcctgccgtgttgcatggatgagatggtccaccacagggtctcggcgtgtcgcctccgtctcgtggggactgacggatcccatgttcaggtgcgcaggcgccgattgataaacgggtataaccaatcgcgataacgtctggcttgcattgtgctgtgcgagttccctaatctgctgcccagacccgagggtcgccagacgaaaacgacgcacggcaacgtgcatgagcgtaaggaacaccatgagcgcacaggaaacccacacaccataccatttcgagacactgcagctgcatgtcggccaggagagcgcagacccggccagcgacgcccgtgcagtgccgatctaccagacgaccagctatgtattccacgacttcgaccacgccgaggcccgattcggtctggccgacccgggcaacatctacgggcgattgaccaatacgacacaaggggtgttcgaagaccgcatcgcagcgctcgaagggggcaccgcgggattggcggtcgcctcgggtgctgcggccgtggagtacgccgtgcgtaacatcacgcaggccggtgaccatatcgtggccgccaagaacatatacgggggcacgttcaatctgctgcgccacaccttgccacgcgacggcatcaccaccaccttcgtcgacgccaacgatccccacgcattcgaggaggcgatcgcagacaacacgaaactcgtctatttcgagaccttcggcaatccgaacgccgacctgcccgattttgacgcaatcaccgagatcgcacaccggcaccacttgccggtgattgtagacaacaccttcgccacgccatatctgttccgcccactcgaacatggtgcggacatcgtagtggaatccgccacgaaattcataggtggccacggcaccacgctcgggggcgtgatcgtcgagggaggcgatttcaagtgggatgcggtgccaggcaaattcccgacgctcaccgaaccggatccctcgtatcatggcctcaacttctatgaggcgctcgggccggtttcattcgtgacccgcatccgcgcggtcctgctgcgcgacacgggtgccacgctctcgccgttctcggccttcctgctgctgcagggcaccgagacgctgtcactgcgcgtcgagcgccatgtggagaatgcgctcaaagtgatcgattacctcaaaaccgtgcccgaagtcgagtcgatctcgcatccatcgatcgagggacgccctgaccacgacctgtacgagaaatacttcccgaatggtgccggatccatcttcactttcgacattcggggcggcaaggatgcagcccgggtattcattgacaatttgcatctgttctcgctgctggccaatgtggccgatgcgaagagcttggtgattcacccggcttccacgacgcattctcaggagtccgagactgagttggaggatcagggcatacatcagggaacaatccgtctgtcgatcggcaccgagtacatcgacgacatcatcgacgatctgaaaggcggattcgaggcggtgcgcgcctccggcttcgccgattgagcatgtatgacgtatgccatgcatatggtcaacagcttttctggggagatcccgcatgcgtgggcatgcgggatctcccgtttgtcggtgccgccgtccatgggcgcgaatcgttcgcccatggacgggtcagctcgaatgatgcaggatatcaacgagatgacatagtatgcttacggttacgtgtgaacgtagggtagaagttcacccagccaagcgcacttgttgtgagattgatggagccgattgtgaccgatgtaatcaccgtgatgaacctgggttggcagtatgcgccctcctcggcgcacggcacgccaagaggggcactgcatgatgtgagttgttatgtggcggagggaaccctggccgggatagtagggccgaccggttcgggcaagtccacattggcgcaggccctcaccggtatcatccctcatattctcgatggcacgcttaccggtttcatcagggtggctggcatgaacgtgaaaagcacgagcgtctctaatatctccgccaaggtggggtatgtgccccagaacccggtggatttgttcgtcaccaacgaggtggagaacgaaatcgcattccccttggagaataggggtgtggcgccggacgaaatacgctcccgtgtcgatgaggtgcttgaccgactgcatatagagggactccggcaccgcgatccgcgtatgctctccgaaggcgagatgatgcgcgtcgccataggctcggccatcgcagcagagcccgaggtgctcattctcgatgaggtgctggcggtgctcgacgaagacggcgcacaggatctctatgccattctggacgacctcatgaagcgcaaccacacgtcggtggtgatgatcgacctcgacactcgttggctgcgggagcatgccgattcggtgttggtgatggtgggcggtgaggtgatccgccgtaccacacgcgaagtgttcctccgcgaggcgtcgttgctggaatcggtgggcgtgagcagatctcgcgacgaccacacgccgttgacaatcgcccgtcttgagccgcaggacgtgaccgatccgatcatcatcttcgatcatgtgtactacctccacccgcacagcgagaacagcgatgccccccaattgcgcgacgtgaacctgcgcatcccccgcggctcattcgtgggcgtcgtgggcccgaacggatccggcaagacgaccttgctgtcgatgatgaattctcagattctgccctcgcgtggccatgtgattgtggacgagaacgacaccgccgagtgccgggtgcgccgcatggcccgtgaagtggcctatctcgatcaggacccgttgcatatgatgctgacgcgcaacgtgcgcaaggaaatcgaattcgccccgcgtgccctgggcgtgccagcccaagaggtgaacaagcgtgtcaatgcgctcatccgggcatttgacctgttcgacattgaagatgccgatcccattcggctgagcaccgggcaaaccagactcgtggcactggcctccacattggccacgcaggcacccatacttgtgcttgatgaaccggtgtccgggttggattaccggctcaaaacgaagttcatgaccttagtgcgagacctcaacaagcaaggcatcaccgtgatcatggcaagcaatgacgatgatctcgtggaacgctactgcacccatgccctgcgtatggaggaagggcgcatagtggactttggccctctgcattccgcgcagttgcgctcattggaccatgatcaggaggggagagtctgatgcgttcgcagttctatgtcccggttgatggttggctcaaccgagtggatgtacgtgtgaagctgttcaccatgatcgccgttatcgtcatgtgttcgatttggggaaactgggtattcctgacggccatgctcctcgcggagcacctgttcctgctgtccacccgcatacctgcacgcaagacgctcaaggtgtggtcattcttcctgccggtgatcgtcattgtgttctgcatcatgctcctcaccgtgcatctgcccggctggaccttgtggcgatggggaagctggctggtcacctccggcaccatggatctatgcgcggtggtggcgctccgtatcgcagatatcgtgttcgccgtgttcaccgtgttgttcaccacttcgcgtgccgcctggatcagtggtctggcgggactgggattgccatacacggcaggggccgccgtgacggatgcgatccagtggctgccgacctatgcggccaccgtgcatgacctggtgctcacccaacacatccgtggacggtatgcgcgcattggcaagcacaatcccctcacccgcactgctgcatggtgcagcgctcatgctcgtgcgatcattgcggcaccagcccatttgagccacctgaaccgcgcccgcagcatcacagctttggctcacggtgcgcatatagaccgcatgggtgccaaacgcacatatctgcatccggcgcatatgcgtctgaccgattggatgctgctgatactggtgctggtgtacatcgccgccgtaattgtgatgatggtcgtattcgggtggtgaattcaccacgatgttgtgttcggggctcatcctcaaggatgagccccgaatgtttttcacccttgcgggtgatgggtcggcatggttgtagggcatatattcgcagatatgcacgtcagagcacgtgattgaagtggcgaaggccccaagaaggagagaacatgtcgaattccgcgttgcagaacatggttgaccagattcaccagccgacccatacgccggtggcgatcgaggccatcgatctggtgaaggactatggcacgggtgaaagcctggtgcatgcgttgaaagatgtcaacgtgcagttcgagcagggccggttcacggcgattatgggaccgtccggatccggaaaatcgacgctgatgcatgtgatgagcggtctggactcggccaccagcggcagcgtcgtgttccaggggcgcgacctgacgaagctcaacgacaagcagctcacgctgctgcgccgcaactacatcggtttcatcttccaaagcttcaatctgctgccgatgttcacggccgagcagaacatcgtgatgcccctgactttggcgggcaagaaggtggaccgtgcatggttcgaccgtctggtggacacacttggactgcgtgaacgtctgggccaccgtccgaacgaattgtctggaggtcagcagcagcgtgtggccatcgcacgcgccctcatcaccaggccgtcgctcgtgttcgcagacgaacccaccggtgccctcgactccgcttcaagcgccgaggtgcttggcttcctcaaggcctcggtacgggaattggggcagacgatcatcatggtcacgcatgatccggtggccgcctcctatgcagaccgtgccatcgtattctccgacggacacatcatcgccgacgtctccgacccgcaaccggcgcagatgagtgatctgctcatgaaggagcgcgaacgttccacgaagaccgccgggcgctccgcagttcagacgatgccggcaaaccagaatccacccattgcgcggcagccccggaacaatccggcggacatcggcggccagccggcacagggaaccctcatgcaggctccgaagccgccgcagcagcgtcgctaatgcaggccaagagcacagacgatcctgaatccgaaggaataccatgttgtcaatcacgatgaagatgatgaagaagaacctgagaatgctgattcccgcgggtatcgccattctcatcggcacggcgttcattgccgcgacgctgctgttcacgaacgccttcgacgcctcattgcgcgaacagaccaccggccagttcggcggctcgaactatgcggtcacggcggatgcgcaatccggcgacgatgcacacgactcaacggttggtggtcttaagctcaataccatagcgggcatcgggggagtggaaggcgtccgtgccgatgtcacgcgcagtgtcatactgaataccggctcccagcacggcagcggggtggcgttgtcgacgagtgccgaccccaagctgctcccggtttcgatcgtagagggcaacgcccccgaaccggatggtgcccggcagattgcaataccgaggaagcttgccgagcagtggaacctcaaggtgggagacaccatctcgtcgcatgcgcaacatggcgacgatgcgcaggacgtgcaggcgacgatcacgggtctcaccaccgatccgaacaacgtgtatggctattacaacggtgcctccgtcgcctcgaacgacctcatggtcgcctattcggatgtcgcctccttcgatgcgataccagcgaccgctgcgtacctgcacatcgagccggcacatgaatccaccgtggtcgcgcaggtgaaggccgcgctttcgccggggctgacgctgcaggatcgcgcgcatatggaagagcaggccatcaaatccctcagctccaacggtggtgacgtgaccaagcagttcctgctcgccttcggtgtgctcgctctggtggtcgccgcgcttgtcatcgcgaacacgttccaggtgctcgtggcgcagcgccgccgtacgctggcattgctgcgcaccatcggtgccaccaagcgccagctctacgtgtcggtgcttgaggaggcgggtatgctcggactcgtgtcctcgatactcggcgtgggcgtgggaaccggcctcatggcattggcctccattgccacacgggaccagtctctcggcggcatgcgactgacgctgaatatgagctggcaggtcatcgcattgcccgtgctcttcggtgttgcaatgacggtactcgcatctgtgagcgccgcacgcaccgccaccagcgtgaccccgttggaagccatgagaccgcttgagatctccaaccagcatcgggcccgtgtgggtcgcgccgtcttcggctgcctgttcctggccctcggcgtcgcgctcgccttgatcgccatcccgatgaaccacagcaaggatggcgatatctccgccagcgcattgctcgccggtgtcggcggctgcatgctcacattcatcggactggccatgacggcgctgttctggttgccttggctcatgaagggcgtgggagcgttcgtctcgatgttcgggccggccgccaagctcgccaatgccaacatccagaagaacccgcgacgcattgccgccacgggaacggcactgctcataggcgtcacgctcatctccacgttggccaccggtgccgccgccgcgaaagcgacgatgaatcaggcactcgacacccgctacagtgtcgacgtcgtggcctatggcccgaatatcccgcagcacgccgcgaacaaggtgagaagcgaacggggagtcggctcactgctgtatgcgaagaccgcgagcgcggaattcaccgacgagcaggggcatgcggtgcccacgacggtcattggcgtgcccgacatcgcggcattgcagtcggtgctcaacatctcgatcgacaatcccgcgcctgcattcggggccggtgatgcgatcatgccgctcgtcaacaacgcaaccggagcatcgttcaccttcgccaacaacacggtgcgtctgagccaaaccgatgccgaaggcaatccgtcgcagcacccggtcgatctgcatgtggaacagcgcgactacaagcgcagcgcacagaacaacgaggcggtcgccttcgtgaacacggcgctgttcgacgacggcacgttcaaggcggacggcaatgctatgctcatcaagctcaatgtgccgtctgacatgtcgctctcggatgtgttcgagaccatcgagcaagaccttgaagtctacccgaacgtttcagtcggaggcccggtggcggaacgcaaccagtgggagagcatggtcaacatgatgctcatgctgctcgtcgcattgctcgcagtggccgtggtcatcgccgtcatcggcgtggcgaacacgctgagcctgtcggtgatcgaacgcaccagggaatcggccacgctgcgcgccatcggcatgacacgcggccagctccgcgcctcccttgcaatcgaggccctgctgatctcgctggtcacgagcgtggtgggcatggtcgtcggcacgctgttcggctggctcggcatctacatcgtgatgagttcgattgccgacgtcgtctacgtgatcgactggggaacctacgcgatcatcctggccatcgccatcgtctgctcgctcatcgccagcgtgttccccgcacgccgtgcagtgaagacgccgccggtggaggcgctcgccgaagcctgatttggaaggatatcaaatacctgatgtcgggtatggagtttatacctgacatcacggcaaagccggccagtagtctccaactggccggctttcgcatatgcctgaacggtacggactacaccaggtggttctcataggcgaagaccaccgcctgcacgcggtcgcgggcgttgatcttctgcagaatatgcgccacatgcgttttcacggtgggcagtgagatgaacagcttgtcggcgatctcctggttcgacagtccatgggcgatctcaatgagcacctcgcgttcgcgttcggtgagggtggcaagctccggatccgtgtattcggcggcgacttctgactgctgtctgccgggcccttcctgggtgacgcccgtctccatcatcttttcgatgagccgttttgtggcggtcggtgcgatgatggcattgccttggtgcacggtgcggatcgagttgagcagcgtctcgggttcggtgtctttgagcaggaagccggaagcacctgcgttgattgccgacatgacgtactcgtcgagatcaaaggtggtgagaatgatcacacgggtgtgctgctcgccatcggcatgtgacgtgatctgcgcagtggccgccaatccgtccatactcggcatacgcacgtccatgagcacaatgtcggggtggagccgttcgacgagctgcaccgcctgcgtgccgtcggaggcctgcccgacgacttgcatgtcgggctgcgagttgatcaccatggtgaacccggcacggacgagttcctgatcatctgcgatgaccatacgaatcctgcttgcgtctgccatgcttccactctagcgaaacgcatgccttcatgcagattccagacatgtgtggaacatatgcatacctgctgtggactgcgggaacgcggtgaattctaggcattgcccacaccacggctctgcgcggcggagatctgctcgtcaagcgatttcgcgggcgtcagattgagctgattctgcgaaggattcgtctcatcgctggcaccggtttccctcagcacaccaagcagttcgcgcatgcgcttcaaagcggtgcgtccctgactgccgatggccgcgaacgcctgactgatccattctgcagacggctcctctccctgcgcaagctgatggtcgatgatcgatatttcctgcgttgtctcgacaatcacgctgttgagcgtttcactcacctcggattggatgctcgcgctgatgcggtcgcgttcacggttggcggcggagatacgttgtttgcgctgctcttcgcgcagcgcctcggcccgggcttccagcacctgcggattcgatccgctgatcttgacccatgcgccgagcgccatcgccagcaggcacaccatgatggacaatacggcgaattcgatgaacacttgactggcgaactcgatgctgacggtgccatcttcgggtcgcaatgcaggcgtggcatgaagcatccactcgacgaccgaggtgtggccctcgacaagcagcatcgtcttgaacgcaaacagcagcccatcgagtgcaatcagtgcgctgagccatttccaggtgccccgtttgctgctgtagagcatggcggcataggcgatgaatggcgccgccaaatcggcggtgaacaatggtctcacgaaaaccagttgcaggaacacgagaatggcgaacgccaatgcgaccgcacgagggaaacgcctgcgccagcacagtggcagcataagcagtacggtcatcatcaccccaaaggcgccggatgccgaggagaagtggtagccggcgacctgcagctccatgccgccaggaaccgtcacgatgatggcggtcgtcacagcgacgagaatcgtgtcggtgagcacataatggtgctcggcccaatgtgacagtctggtaatccagttctcgtgtccgtcctcgtgtatctgcgcgatgggtttggaacgcaacgactcgcccagttgcatgaaattgggccaaatctcgtggtcgcccttgtcgttgccctgctgagcatccctgtcatccacgtctgctccggtactgttggccgcatcaccgtcccagctttcctccgagacttccacggcggaggagccgccgtgcattgctgtgtgcatcgcacttgcctgcaggagcgattccgagccgatgccggcctgctgcacggaggtggccaatgggacctcagcatgcactgcgaaaccgccgttgagacgggggcctgcctccaccatgccgccgacggcttcgatgcgttcgttcatgccaagcagaccgtagccggccttatgcccatccatggccgccgaggcaccacgtccgtcgtcgctgatggtgaaggaaagggttccgctgttccactcctcacgcacttcgacgttcacattgagccccgcgtatttgcgtacgttcgtcaatgcctcctgcaccacgtggtacatggccacactcgccgactcgctcaatagctgcggtgagggctcacccacgagctcacgtcgcacgtggatgtcgggggagaccttggccgcctgctcgatcaaggcattgatatcgtggtagtcggcatgcgacgagcccccgaatacaccgagcagctgcttcatatcgtgcatcgcatgttcggcctcgtgccgaatggtgtccatcgtcgaccgtgccagttgcacatcatgggtggcggcataccgcccaccgtcggattggatgatgatgatcgaaagggtatgggccacgatgtcgtgcatgtcacgggcgatgcgcgcacgttcggccgaggcggcgatgagtttctcctcctgctcccgggcggctatggccgcattccgctcgcccaacatgcggatcgtgtgttggcgcgcccgttgccatagtgcggccacgagcgtggtggccagtaccagcgtgaacatgatgaagtagaggaggctcgattccatgctggcggctgcacatgactgcatcgagaatccggccccctcgggcgcacaggcatagacccctgacaggatcgccatgtgattgcgcccgaagattgtgccatgggtgttcgcgaatacgatcacggcgacggtggcgacatcgaaggccaacgccatgatggcgtattcgcgggtccggttccggcaatcatagaccaccgccgaatagaacatgggcaacgccatggcatccgcaaagaggaatgccggcccgaacaccagctgcaccgccaccgtgacgacgaaccagatggcggcggcatgcggcttcgtgcggcgcaatgcgaagggcaacgtgagcagaatcgaccagatgcgcgtccacccgtcggcatcccagcgcaacagcaggccatcctccagaaatggcgggatcgtggtgatggcccacagcaggcagatcagcatggtggccatggtgtcgatgaccagcatgcggtgtgtcgccaagaaggctttcaagcgttctcccatatcttcagcatataggccacagaccacctgcacatgggtctgtgggatgattgtgcctccttgtcggtgcatgtgggtgagattgaaggcattgcatcgttcaaatgccgtgagggagtatgatggcactgctcaatgaatactatgttccgggactccatgtgtctgagtatgcgatcgacgtgccactcgactgggatggccatgagccaggcatgggattcgatggagagacgattcgcctgttctaccgcgtggtctgtgccccggagcatgtgaacgaccggttgccgttgctggtgttcctgcaagggggtcccggcggcgcggctccccgcccgctctcgcccgactccgatggctgggttgccgaggccatcaagcatttccgtgtggtgctgcccgatcaacgcggcaccgggcgttcctcgcatatcgactcacacaccgtggcgaatatggacggacggcaggctgcggagtatctgaagaaattcctcgccggccccattgtgcgcgacttcgagcacctgcggcgcaccgagttcgatggggagcgctgggtgacgctcgggcagagctacggcggattcctgacgctgacatacctttcgctgttcccccaaagcctcatcgccagtttcaccaccggtggcataccccatgtgccggcgagcgcgagggaggtgtacgagcacaccttcccacgcatgcagacgaagaccgaacagttctacgcacgctacccgctcgacacgaaacgcgtgggctgcgtggccgacattctgcgcagcaccgatgtgacgctgcccaacggcgacccgttcacagtggagcgtctgcagaccctcggctcgagtttcgggatgaaaccggcattcgaacgggtacattggctcttcgacgaggcatttctcgacggcgacggttcggcaaactcggattccccgctcgccgacgagttcctgttcgatgcgatgaccgcgacctattccaatccgctgtattggccgctccaggagttcatctacgcggacggcgacctcgacgcccccattgattgggcggcggaccacgtgtatgggagtctgccgcagttcagcactgacgcgcgcccgttgctgttcaccggcgaggcgattttcccgtggatgttcgagcaggagcgcgcgctcagacccttccgcgccgcaatggacgtgctgatgcaggacacgcatttcggggtgatctacaacgtgaaccaactcgccgcgaacacagtgccgctcaacagtgcggtgtatttcgacgacctgtatgtcgacagcggtctgcagctcgacacactttcgcgcataggaaactcgcattattgggtgacgaacgagttcgaacacgatggcgtgcacggtggcatcgtcttccgtcatctcttcgacgaggcacgcgaccgcggcgacctgcacgaactgttctagcatcgggtttttccgcaggtcgtatacagtattggcatatcggacactgtcaggagagtggtatgaaggttggtttcattggctacggcaacatggcacaggcaatcgcacagggattgacccgtgcgcatgcggtcgacgggaacgacattgtggcatgcgccgcgcatttcgacaagttggaacgcaacatcgcggcagtgggcggcactgccatgcacaccccgcaggaggtcgtcgcggccgccgacatggtggtcgtggcaatcaaaccatatcaggtcgaggatgtacttgctccaatggccggagcactcgccgacgattcgaagatgctcgtatcgcttgccgcaggctgggatctggcgagataccagaccctgttcggtggggcggccaccggcatccacatccagtgcacgattccgaacactccgatggccgtggcccagggggtgctgatctgtgagaacgtgaacaccctcaccccgagccaatgccagggattcgtcgacctgttctcccgtatatcgctcatcgaggaggtcgataccgcgcatatggggattgcgatgtgcatcgccggttgtgccccggcgttcaccgacatgtacttggaggcgctcggcgacgccggcgtcaagtacggtctgcagcgtgcgaccgcatatcgtttggccgcgaagatgattgaaggtgtcggtgccctgtgcctcgactcgggagttcacccgggtgccatgaaagatgcggtgtgttcgcctggcggcaccaccatcaagggtgtcgccgaactcgagaaccgtgcgttccgtggtgcggttatcagtgcggtcgatgccatcgagcagggctgaatcgttctcgtctgtattccgaacgaatgccgtgacgccggtgagggagcgtggtccacgctgccgcaccggcgtttcgcgtagatgtgcaaaaccggtgaaatgacttggcagaccgctagtgtaggcactatgtctcttactatcggaattgtcggcctgcccaatgtgggcaagtccaccatgttcaacgcgctcacccgcaacaacgtgcttgcggagaattacccattcgccacgatcgaaccgaacaccggcatcgtgccactgcccgacaaacggctgccggtactggccgagcttgtgcacaccgacaagatcgtgccggcaaccgtcaccttcgtcgacatcgccggcatcgtcaagggcgcgagcgaaggcgagggactgggcaacaagttcctcgcgaacattcgcgaggcggatgcaatctgcgaggtcgtgcgagcgttcgaagacgacgacatcatccatgtgaacggccatgtcgatcccgacgatgacatcgacacgatcaacacagagctcattctcgccgatctgcagacgatcgacaacgcgctgccgaagctcgagaaggacctgcgcggcaagaagatcgagaaaagctacatggatgccgtgctcaaggcaaaggagatcctcgaatccggtcgcaccatcgatcaggctgcgcaggccggcgagatcaagaaggaagaggtgtacgacctgcacctgctcaccgccaaaccgttcatctacgtgttcaatgtggacgattcggagctgcagaacgaggaactcaagcagcgtctggcgaagtcggtggcacccgccccggcgatcttcctcaatgcgcagttcgaatccgaactcaccgaactcgatgaggcggatgctcgcgagatgctcgaggatgcgggactggacgagtccgggctcgaccagctcgctcgcgtgggcttcgacattctcggcctgcagaccttcctcaccgcaggggagaaggaggtgcgcgcctggcagatccacaagggttggaccgctccacaggcggccggcgtcatccacaccgatttcgagaagggattcatcaaggccgaggtggtctcatacgacgatttcgtagaggcctacggttcgatggcgaaaatcaaggaagagggcaaactgcgcctcgaaggcaaggactatgtgatgcaggacggcgacatcgtcgagttcaagttcaatgtgagtaaatgatcggcatatggccgagggccttggccgaagacgtcaatgccgcatgacccgggagggccatgcggcattgtgctccttcaccctcggctcatccgtcgatggcatcggctgcgcgtgcagcagtgatcatcgtgagcatcatcaccgaaggctcaagtgccttcaccgcgtgcggcagtcgggtcggcaaatagacgaggtcgccgggggccacctcgcgttcgtcgtcgccgccgttgacgagcaggcgtccacggagcacctgtatgaacgccggcatggcggccgtgtgttcgctcagttcctgccccgaatcgaaggcgaatagcacgacgttgccgccttcggttctcatcgcggtgcgcgagaccgtcgcctcgggctggatgctcaccatatccgccacgccgtcgagcatctgcatccccggttcgtccatttgcatatgacctccttggttaccaaacatcctgaacgtatagcctagccaaggcgcgccgaattgtgcatcgaccgccgctgagggcataaaaaagccccgcgtatcggagcggagcttgaatttgcatccagaatcgcaagatgttgcgataggggagcggaatcactcggcctgcccgccgccggccttgatacccgtgccgtcaccgctgggggcttcggactgcgggaacggattgctcggctctgcaggctggcgaacctcgttcgatttcggctgttcgcggctctcggtctgcttcgcgctgcagttgcagccgcatcccttctcgcccttctcggctgcgtcggccttgccctggaagtcgaggtcgccgtcgctggaggcgcccggcgtggaacctccgttagccgtgccgttgttcatgttgttcgaatccatattgttcgttgtggtagtcatggtgttgacctttcttttgctgttgctctcatcatagaaatcatttatgcaagccgtatgcatgcatgctgcccattccatgacaattcatgcaggcaacgtacagagaaggctactttctacaaaaaaaacagggttaatttcgtatcttttagggtgaacaatctatcgtgtcaaagggtaggagaattcccgtatgccgtgtagcacacgttcgctttccggaagccaggtcatgccgacggggaacacatggccgagtgtctgcgtgcatggcaccttgaaatcatggagttcgaaatcacggccattgcgggcgagggacgtcgccaaggccagcgtctccgactgcacaaagtcgtcgctgctcgtcaccaggaacaggggtgggatgccgatgccctgtgtgagccaatccgcgggatccaggaacacggtggcatcgtcaagtcctgcgaagaactcgtttcccactgtttcggcaagtcgcgcgcgcattggcgaactcggcgtgatgtcatagactcccgagatgagcgaagctccgcgcaggtggattcccgacgcccgttcgatgccgaatgcgtgggcggcatcgtcgttgtgctcgatgagcaaggtgagcagactcaggcatgcaccggccgaatcgccggtgatgaagatgttgtccggactgacggggaactgtgtgatatgctcgccgatccagcacagcgccgcctggatgtcgtgcaattggccgacgagatcggtctgcggagccggtctgtagttcagcgagaacacgccgaacccgagatcggcgagatgcgtgttgaaattgcggttgagctccttgtacccataggtgaacccgccgccgtggatgtctatgtacaccggcaatgtgttgccgccgcgaactatggcatcgcgtgggatgtagacgtcgagcagatggccgcgcacttcgccgtcccggtagccgccgtccggcaggtaggggatgtcggtgtgcacatacacaccttgcggatcgtgccattgcaatgcgcgtgcatagtcgaacatcgcgcattccttgcggaatctgaggcaggcggctgccgtgcgctcctgtacgcccggttcgtcggcatgcagatcctccgcaatcgccgtccagtaacgggccagaccgatcactgcgtcgcgaaattcgctggtgcctggcgtgtattcgatgggtgggatctcattgttcctgtacagctccataaagcctccatactgtttggaacaacagtatgacgatgtcttgtctatatcgttgcgggagatggatggggccggatatgggaaagccgggtggcgtacaggctcacccggcttgttgtcaatcgatgaatcagcgtgttagcgcgtcggatctattggttcgtcgaggttctcgaacttgcgttcctgtggtgtgggctccggcgcctccttgacgatggtgccggtggcgcggccgatggccttcatgccatggtagagcacgagcacgatgatggagccgatggcgatgccgttgaactggatgccgttcacattgaactcgaagttcgcgatgccgacgatcatgacgaccgaggccgtcatgatgttgatcggtttggcgaagtcgaccttgttgtccacccagatctgcacgccgatcatgccgatcatgccgtagagcaggcaggtgacgccgccgagtacgcctaccgggatcgaattgaccacctgaccgaacttcgggcacagcgaaagcaggaaggcaaatcccgcggcgcaccagtaggcggccgtggagtacaccttggtggcggccatgacgccgatgttctcgccgtaagtggtggtgcccgaaccgccaccgatgcccgcgactgtcgtacccaggccatcggcgatgagggcggtgccgatctggtcgtcatagttatggccggtcatctgggcaacggacttcacatggccgacgttctcggcgatgagcacgagcacgacaggcaggaacatcggcaggatcgtgaagtcggcctgaggcaggtggaacttcgggaagccgacccaggcggcctgttcgatggcctggaaatcgacctgtccgcgaatgcatgcgtaggcgtagcctacgagcacgccgaggaggatgttgagtcggccgatgagccccttgaatagcacggcgatgagcagcacggctgcaagggtgaccaatgcggtgtcaggggcggccttgaaattggtccagacattcggggccagattgaagccgatgatggccacgatggcaccattgaccacagggggcatgattcggtcgatccagatggcgcccgcccactggacgacgaagcctatgatcgcgagcagcaggcccgtgcacagaatgccgaaggacgcgacggcaatgcctttgccggaacttgccacggctgcgatcggggcgatgaagccgaagctggaacccagatacgacggcagcaggttcttgttgatgagcaggaaaagcgccgtggagaacgccgtgaagaacagtgtggtcgacgggtcgaagcccgtgaggattgggaccaggaatgtggctccgaacatggccaccacgtgctgtgcgccgatgccgatggtgcgaggccaggtgaggcgctccttcggttcgacgatctcgccgggcttgagtgtttttccgtttccatggagcgtccatgtgaacatttgcttcaatgatgtcacgatttcctcgccgtttctctctgaggtcacttgagctttggaaaatgcggccataggcgttatgccaccggccgaatacattgtagcggcagcgggaaaccactgtgtgacatgtgtgaagcagcaggtgacggcatgtgaaaagggccttaggatagtcccaaggcccttttcacatgggtacacataggtttcgaaataccggtggtgtcagaagaacagcaccgccagaccccagcagatgagcaccaggatgatcgaggcgatgaagctggcgatgagtggcttgacgccggtcttcgcaatcgccttgaagttcacgttgatgccgagggaggccatggccatgccgaggaagatcttcgccacattgccgccgagtgcgttgatgaaaccggcgctggcgggaaccgtctgcaggaacagcgtgccgatggctgccgtggcgatgaatccgagcatgaaccaggggaatgcgaccttgcgcttgccacccacctcggtgacctcgctatggcgcttatcccaccagatggccacgatgatcgagacgaacacgagcatgagcacgcgggaaagcttcatgatgttcgccatggtggccgcatcgacctgaccggcgggaaccggacggttgaggccttcgccggctgcgacggcatgggcgatttcgtggagtgagccacctgcaatgaagccctcctggggctgggtgaggttgagcagcggcagaatggcgatttcgagcaatgcgaagatggtgcccataatggcgacgattgcgattgcggtgacttcgtcgttctccttctcgctctcacgtttcggggagaccttgatggagccggagacgcccatgaccgccgcagctccgcagatgccggtgccgcaggagaccagtatggccatgagcgggtcgacgcccatccaacggcagatccagtaggtgacgaacacggtgacggtcacgacgagcgcggcaaggggcagacacttcgcgccggtggtgaaaagcagttcgagattgagcttgaacccaagcaggatgatgccgaaacggaggaacttgttggcgatgagaccagctgcgtccttcacccctgccgcacgttgcggatcatccttggtgtaccaggcacgaatcgggaactgaaccaccatgccgatgagcagggcgataatgagcgcgccgaggatcttgagaccctcgaaccgcgcggcccacatgccgatgagtgtggccgtcaatgtgatgatggcaatcagcgccatctgtttcgtggcaatgcgtttggcccattttctacagaattctttcatggttttcataatacagttgctccatgcatgagacgagtatttcatttatttgagcaattgccgtggaagtcatactgaaacgccggccattcagctcccgtggcgtgtccggtgggcccatttggttgtggccgtccgctaaactgggtgagtttgcgcactcgcgcatcgtattacgacctgaaaggccatcgtgccacttacaccatcgttgaatgatttagataccactatgaatgatgcagactctgtatatgaggagcccgcgcagtcgttcggtgaactcggcgtgcccgggctacttgttcgcctgctggccgccgacggcaaaaagaccgcgttccccattcagcaggacacgcttccggattcgcttgccgggcgtgatgtgctcggccgaggacagaccggttccggcaagaccctggctttcggcctgccacttgtctccagactctccagcatggatcgcgccgacgatcaggatttcccccgcgacatggattcgcagacgttgcgaaaatcgctgcgtttcaagcgcggtgtctcgaagtacatgccgcatccgcgcggcctggtgctggcgccgacccgtgagctcgccaaccagatcagtgacgtgctcactcctctcgcagatgcctatggcatggctgtcactacggtgtatggcggtgtcaagtatgaacgccagttccgtgctctcgacgcaggcgccgacatcgtcgttgcctgcccgggacgtctggaggacctgatcgagcagcaggcgctgacactcgccgatgtgcgcatcgtggtgctcgacgaggccgatgagatggccgacatgggttttcttccgccgatcaaacgcattctcaagcagattcgacaggatgcgcagcatatgctgttctcggccacgctcgatcatggcgtggacgaggtggtcagtgaattcctgcatgatccgaaggtgcatagcgtcgacgaggtgacgtcgaacgtcgattcgatgacccatcatctgttcctcgtctcccgcaacgacaaggctgccgtcgtgagggagctcgccagtggacgtgggcgccgcatcctgttcacgcgtacgaagttccaggcgaagaagctcgcccatacactgacgcagagcggaatcccggcagccgaactccatgggaacctgagtcagcaccaacgcgatcggaacctgcaggtcttcgaatccggtcaggtgaacgtgctcgtggccaccgatgtggctgcccgcggcatcgatgtgagcaacgttggtctggtggtgcaggtcgagccgccggaggatcccaagtcgttcacccatcgttccggcagaaccgcacgtgccggccagtccggcgatgtagtcacactcatgacgccggatcagaagcgcaagattcgtcacctgttcaaagaggtcgacatcaagctcaaaccagtcgaagtcacccccgaatccccacaggtgcaggaactcgtggggcagaaagccgatccggtgcatggctgggagcttcccgagcttgagcgcagacctcgtaaaggcaatggcggcaagtcgcgtcgtgaccggggtcgcacgaaccgtgatgaggaacggggcaaccgctcggcccgtggtggacgccgtaccggcaagggcgagcataggcccaccgaacgcgaacgccggattgccaaggagcagcaggaattcgccgcattgttcctcggcgatgtgagttcggacaacccacgttactccgagcctgcggagtcggaacaggcgagccgccatgagcgcaatcatcggcgcgacgaacggccgtgcaaccggcaggaacgtcgcgccgagcagttcggcgaggccggtgacgaccgcgattacaagaaatcacgccagaaccgcaacaacggcaagaaacgcatcgaacggcgtcgtgcccgtcgcgaggaggagcgtgaagagcgtcggggtggcaaacgcatccaccaccacgacaacggccgtctgttcgatgcccgcgatgaatcggtcaagcgccatgaacgcaggctcgaggcccgcgagcagagtcgaaccacccccaagcgcgcccagaaatcaggcaagcatgggcagttcaagaacaagggcaagcgccgcaacaacaatccgttccgcgggggccgtggccgtcgctgaacgtgtgtacgggttcgccctttggccgtgagggtgggcataggcatcgtcactgtcgcaagctcccttacgttcctcagcctatgcccaccctcacggccaaagggagtgccatctcgcatgttcaggctgtattgccggtgtttggggtggggctggcaggcacatcgaggaacgtaagggagcttgcgacagtgacgaaatgtgcctgccagccccaccccaaacacctcacctgattgattgtaagaattatttctgggggttctcggatgaagttgtagccgagggatctccgccgttcatgaagcctgcgcagagcgcattgaggtattcgggggcgaggcgggtggcgaaggcgacgccctttgcaaaggctcccgcatagcccagcgcacggccgagttgcatcttgcggtacgcgaactgggcaatggcctttggcgtggagggcctgaccatcgtgaagaaattgtgcccctgcatggcagcggccttttcgaatccggtgctgatggatccggggcagatgcatgtgacggtgacgccggtgccgcgcacctcgcgggccacggccacactcagtgagcgcacgaaggccttcgaggcgtaatatgcggccatatacggccccggaatcgtcgccgcgaccgaggcgatgttgagaatccgcccgccgtgacggcccaccatgtcctcgccgaacagacgcatgagcttggccagcgtaaccatgttcacctgcatcatcgcattgagtttccgcctgtcctcatgcatgaagtccgcccaatccccgaagcctgcgcaattgacgagcgtatcgatcacgatgcctttctcctgggcatagcggaacagtttctcggcggcctcggtgtcggaaagatcgagcaccaccgacgtgacgtgcacatggaactgcttgatcaacttcgcctgcagctcggcaagctggtccgcatgccgagcagtgagcaggagatcgtgatcgtcgttggcgaacagcagcgccagttcgcgccccaagccgcctgtcgcaccggtgatcaaagtggtcataatgcctcgattcatgcaatgttctgatgcgtgggtattgacatgcgcatcgatatgccccacactaatcacgcgggttgcccatggcatgcatttccgccacgcgtggagcgcggcgggaatatgtgtggacgcgcccacgttgtcgtaacgcaggcattcatccagtgggaggtgcaacatgacgttggtttggtcgattctagttgccgtggcactcaccgcgttcatcgtatggttcttcttcgcccctaggaaagcccacaaggcgcaggtctcacagggtatgcagaccgcgcatgtcgtcgtccgcggaggctacgagccgtcgctcattgaggtcaaggccgggacgccgatcgtactcgacttcgataggaaagagagcggggaatgctcctcccacgtcgtgttcccggagctcggcatagaccgcaccctgcaggcgttcgcccatacggaggtgaggctgcccgccctcgcacccggggaatacccgttcgcctgtggcatgaacatgctccatgggatgctgcgggtgaccggtaaaggcaacggggaaaccgcagcagccgaatccaatggcgtgtcggaggccacgggactctccgatgcggagcagctcgaacagctgcagtcggcggacgacgccgagcgggagcatgagatcggcgagctcaagagaagactgatcgtcggtatcgcgttcacggtgcctgaactgctcatcgccatgctgcccatgatccccgctgtgggggcatggatggcgcatacgttgcccgcatgggtgatgagcccgtggctgcagctcatactcacggcaccggtgatgttctattgcggttggcccgtccatcgtaccggttggctcgccattgcccaccgcgcaccggagatgaactcactggtcaccacgggcacctgcgtggccttcctgtactcactgttcgtcacgatctggccagacgcgctgcccgtggggtcacgcgaaccctattacgaggcggtggcgacgatcatcacgctgatgatcctcggacagctgttcgaagcgaaggcgcaggccggcaccggtgcggcgatcaaggcgttggtaggacttcgggtgaacacggcgcatgtcgtcacggagcatggtatgcgggatatccccactgccgacgttgcggtgggcgacatcatcgaggtgcgccccggcgagagcctgccgatcgacggcattgttgtgagcggccacacaagcatcgacgagtcgatggtgacaggcgagtcgatgccggtggcggtgggggaaggagccagcgtggtcggttcgacggtcaacggcaatggcacgatccgctaccgtgccacccgtgtgggatcccagaccgtgctcgcacagatcattcggctcgtgcgtaacgcgcagacctcgaaggcgcccatccagcgcattgcggaccgggtggccggcgtgttcgtgccggtcgtcatgatcatcgccgtctggaccttcgtcttctggcagatggctccgatgccattgcatgtgctctacggcattgtctgtgcgatcagtgtgctcgtcatcgcctgcccgtgcgcgcttggactggcgaccccattgagcatcaccatcgccacggggaagggtgcacaatatggtgtgttgttccgttcggcgcaggcgctcgagaacacgcatcgcatcgacaccgtggtgctcgacaagaccggtacgatcaccgtgggcaagccgcaggtcgtcgacgtggtgggcctggccgatgatgacggcggtccgatcgacgtctcccatatggctaagataccgggattctcgtatgtcgccgcagtagaggcgaaatccgagcatccgcttgccgaggcgattgtgcaggcatatcgctccgaggtgcaagccccgcatggggcgttgccacaggtgcgcgattttcataacgagcccggtggcggtgtgagcggccatgtcgaaggccaccgcgtggtcgtaggcaatgaacgcttcgtgcaggcgcatgttgatgaagatgcagctgtttcgaagcgggtgcatgacgccgtcgaacagatggccgagaaagcacgcacgccggtcgtcgctgccgtggatggcgtcgtgatcgcggtcgtcgccgtcgccgatgcgctcaaggagacctcggcccaggcaatcgaagcattgcagatgcggggcatcgacgtcgtgatgctcaccggcgaccatgaggccacggcacaggcaatcgcccgggagctcggcatcacccatgccgtcgcacaggtcacgcctgccgataaggaggccgttgtacgcgaactgcagaaccagcaccgcgtggtggccatggtgggcgacggcatcaatgacgcgccagcgctggccagggccgatgtcggcatggcgatgggttcgggcaccgatgtggcggtggaatccgcggatgtgacgttgatgaattcgtcgctcgagtcggtggtcaccgccatcgatctgtcggatcgcacgatgcgcaacatccaccagaacctgggttttgcgcttggctacaacggactgggcatcccggtcgccgccggtgtgctctacccactgtggcatgtgctgctcagtccgatgatcgcaggtgccgcaatggcattctcctcgttgtccgttgtgctcaacgcaaacagactgcacgccttcgtgccgaaccatgctaagcctgtacgcagaggtgcgcgcacgccgttgaatcttcgtttcgcgttgccgtcgcagactctccagtcctgcggcacgcacaccgactgccggcatgaatccatcacggaacatgaacataaggagcataccatggcacatcaggaacacatcgacccaatctgcggcatggtcgtcgatccgaaggacgccgccgacacccgcgtctatgacgggcggacaatctacttctgcagcaagcattgcgcaggtgtcttcgacgaggatccggcgaaatacgaagtcgggcagtgagatgacaatgcaacggacggaggcggccgcccccgagacgcatgtggcctatatggccggcggatgcttctggggactcgaacgagccatgcagaatgtcgatggcgtccttgacaccacggtgggatacgcgcaatccattacgccggatcccacctatcgcatggtgtgttcgggaacgacccacgccgtggaaacggtgcgcatcgattacaatccgacgcgggtgagtctgcgaacactgaccttgctgttcctgagcatcatcgatccattcagcgtcgaccgtcagggcaacgacgtcgggtcgcaataccgttccggactgtatccggccggtgcgcatgccgccgagcagcgcgcggtgtatgagcaggcgttggacgaactcgcgcaacgctccggatcgactccggccgttgagatcgaggatttgcgcaatttcacgattgcggagcccgaacatcaggattacctgctcgccaatccaacaggctactgtcatattccactgagcgtgatcgaccacatgcgcgaacgtcagcgtcatatcgaacgcatctggagcctgagcccggaacagtatgcggtcacgcagcagtctgccaccgaaccgccgttccataacgaatatgatcgtctgttcgaccccggcatctatgtggatcgagtcagcggcgaaccgttgttcttctcgaccgacaaattcgattccggctgtggctggccgtcgttcagcacgccgatcgatcaggggtcggtacgcatggtcaaggattacagcttgccgctgcacccgcgcctcgaggtgcgggccgtgcaatccgacagtcatctgggccatgtgttcgcagacggcccccgcgaacgtggcggcatgcggtactgcatgaattcggcgtcacttcgattcgtaccgcgagatcggatggccgaggaaggctatggggatttggtaggagagctcgacgcgcggctgagcgcttctgccggcgagtgaggaatcccgttccggttcagtgcgtgtgcatgcgttcggcaatgctcacgataatccccacgacaaacccggcgagcgctggaacgacccaaccaagagccaccgagttgagtggaagccaattgcacgcagtctcgagccataccagccgtccgccgaatgcggcgacgagattggcgatgccattggccacgctgtcgatggcggtgaacagcaccgtccagaaatagacagcagggaaatgccgcgtgaacacgccatgcaggagcgagagcagtacgagcacgatggctatggggtacagggcctccaacaccggtacggagagtttgatgatggcgctcagcccaatgtttgcaatgaccagtgcgatgagtgtgaaaacgatggtccaaccccggtagccaagcacggtgccgaactgcttatggaagtaggacgaacaggtggagaggagtccggagcacacattgaagcaggccacaatgaaaatgagtcccacaaacatggtgcccacatggccgaacagacggtcggtgagattggtcagcacggtggcgcctgtatcggtggcgccatcgattgcctggtacgaaccggagaccgcccccacaaaacccagcatcgcatatattatggcgagcatgatgccggtgaagatgcctccgatgccggtctccgcgcgattgtcatgctcgtcttcgacgcccatcgaggagatgttcgcggagatgacaatgccgaaatagaggccggcgagcaggtccatcgtctggtagccgtcgatgaagccctgcatcagctgatggtgcgcataggagccctgcggattcgcgaatccgggatgtttggcgaacaggcaggcggcgaacagcacgacgatcatgacgagcagcagtgggcccatcaccttgccgagcacctgcgacagcttgtcgggatgctgggccacgaggaacgccaagccgaagaacaccaatgaatacagcagacgcaccagccacaggttctgttggccggcgaagggaacgaccgccatttcgaacgaggtggaagcggtgcgcggaatggcgaacagcgggccgatcgtgagcatgatggccacgcccagcaccagagcgaaacgtttggacaccctggcgctcagattgccgaatccgcccgcctgcgccacgacgatcacgccgaggatcggcagtcccactgcggagacgacgaaaccgaccatgcccacgagtgtgcgattgccggcgagagccccgagataggggggaaagatgagattgccggcaccgaagaacatcgagaagaacgtgatgcccacgatgatgcgttggcgtgtgtcgagtcgcttatgcgaatgaggattcagtttgcccatgtctgctcctgtgtgccgtgtgtgccgtgtgtgtcctttcctattgtgcctgcctatgcgacagatttgtgcacgctgtcagaggaaaacgtgcctgtgccgtatgttcggttctagtgtggcgcttgagcgacatcgaggagacgccatatgaatgtgaacacgcacgtatgcggtcccacgctggttctggcctcgtcgagcacagggctcatgcctgtgctgagacgtgagctcggcccgttgcgtggcgtccgcatggcattcataccgacggcgagcacggtggagtcgtatggggtgcttgtcaggctcatgcgcatacggttcgcgctcgctggattgcgggtgcagatggtggatcccgaacgtatgcccgccgctcaagtatgtgcgcgattgcagtccagcgacatcatctatgtgggtggcggcaacacattccatttgatgcaccatctgcatgcggccgatgcggatgacgtcattcgcaagctggtgcgcgaaggggtgccgtatgtgggggagtcggctggggcggtggtggcgtctgacgacatctcgtacatcgcgccgatggatgagaacagggggcatacgcgtatgcgggggctcgccctcacgcgcttccatgtcattccgcacgtcggctcggtgtcgatgggctccagcgcacgtcggatcgtcgccatgcatgccgggcagcaggactatgtcccgctgttcaatggtcaggcattggtcgttcgaggtcatgtggctcgaattgcctcgatgcctttggtcgagcaatttcgccgactacgcaatgcatgccgtgaatgcatgcacagtgcagggaagatgcatgtgcattaggcagaatgtgggctagacttggtgacggaacacaatcgaatacaggaggcatacatttatgagtgcaccggcaaatgtgggtgtcgtgggacttgctgccatgggggcgagcctggctcgtaatctggcccgtcatggcaatgccgtggccatctacaaccggcattattcccgtaccgagaagctcatggaggagtatggcgacgagggcgcgttctacccggcgaagaccgtcaaggagttcgtcgatctgctcgaacgtccccgcaccgccatcatcatggtcaaggcaggatcggccaccgatgcggtgatcaacgagcttgccgaatatatggagcctggcgacatcatcgtcgacggtggcaatgcctatttcaaagacaccattcgccgtgagagggaactgcgcgccaagggtcttcatttcgtgggcatgggtgtctccggcggcgaggaaggcgcattgcttggaccatcgatgatgccgggtggcagcgatgagtcgtgggagcgtctcaagccgattctcgaatcgattgcggccaaggcaacggatggcgagccgtgtgtcatgcatgtgggggaaaacggggccggccatttcgtcaagatggtgcacaacggcatcgaatacgccgacatgcagctcatcgccgaaagctacgacatcatgcgccgtggcctgaacatgacgcccgatgagatcggcggcgtgttcgaaagctggaacaagaccgacctcgactcctacctcatcgagatcaccgccgaggtgctgcacaagaaggatccgcgcaccggaaagccgttggtcgatgtgatcgtcgaccatgcaggcatgaaaggcaccggaacctggacggtgcagaccgcccttgaactcggtgttccggtcaccggcatcgccgaggccgtgttcgcacgcgggctctccgaccagaacgtactgcgcgagatggcacagcagaatccgtttgcaggtcccgacggccatatcgatctcggcgatctgagccgcgaggagttcatcgggcagatccgtaacgcactctatgcttcgaagatcattgcctatgcgcagggcttcaatgagatcagcgtcgcggcacggacctatggatggaacattgacatggcgcatctggcacgcatctggcgcgccggctgcattattcgtgcgcagttccttgatcgcatctccgaggccttcgaatccgggcaggccgatgtctcgctgttgttcgccccgtatttcaagagcggcatagagcacagcgaggcggattggcgcagcgttgtggccacctcagccaagtccggcctgccggcgccggtgttctcgtcatcgctcgcgtatttcgacggcctgcgtgccaagaggcttccagccgcgctcacgcaaggccagcgtgatctgttcggtgcacacacctatggccgtgtcgatatgccgggtgcctaccacatcctgtgggctacgcctgagcagaatgaagtcaagatctccgactgatttcgcttgtggtatgggaacggggcggatgcatgaacatgcatccgccccgttcccataccacaagccgtgcggatatcagcagtcccggccggccgcctcgtcagtgatccaaagcacctgctgcacagcatccgcataggaggcgggaagggcaggattgttctgggcgtggaacgtcaatcccatcgcctcggccttgccctcacgggagccgcacacccatacgtaatccgtcctcacgatcatcggcaccgtcaatgacaggcgcaatggaggcatcttcggcgaattcgtcacacccgtcaccagcacatcagggtcgttgatgccgacttggggcatattcggaaacagggaagcgaagtgaccgtcgggtcccaggccgaacatcgcgatgtccaaatggccattctcaccgagttccttttcgagctcgtcctgataatcggccgccgcagccgccaacgccacggcgttgtcctgatcggtggcggctgcgagctcctcctgcgaacggcggtctgcaggcatttcgtgaatctggttgcgggcgatgcgtttcgtttccaacagcatgtcgagcagcgcgtcagatgctcccacggcattgcgctcggcgctgttcgcagccacgaagcgctcgtccccccaccacagatgcaccttgctccaatcgggaacgtcaagcagcggactgcctgcgagggcgcggaggatggcggtgccatcggtgccacctgtcaatgcgatgtcgacgcgttcgcggtcgggacggcacagaatgtcattggccagcagcaatgtgcgtgccgccacggcatcggcgagaagttggggggtggagtaggagatgtgttcgcggttcatgagtcctcgtcttcgaaagggtggtaaacaagatgctgcccgctcaaacaagcgggcagcatgcggggcagggaatgtgttagcggatgctcgggtgaatcttctgccagcccttggtgagcacttcggcatagatttcatcggggtagagtctgccgagttcctcgctcatgcaatcgatcatcgaacggatcggcagcggcatggcctgtggtgactggccgggtacgctaatgcgcgcaatgccctcttcactcggacgccgttccagactcagctcgccgtccttgcgggtgaggtagacgccggtgatcgcctgcgcatttggctcgatttccatggtgaccggcacattgagtcgcagggtcagccatgcggccaacagatccattggcgggtagtcctgctcgccggtgatgcgcaccgactggatcggcagatgcggcggctgatccaccattgaggcgagcacggcacgccacagcgtcagccgtgtccacgacaggtcgacgttcttcgacgaccagttgcggcgtagatcctcaatggtgcgttgcgggttcgatgaacgatatgcgtcggtgatgcgcgtgtgtgccatctgtccgagcaggtcgtgtgacgggttcgccggcgcttcggtcggccaccacaccaccatcggggtgtcaggcagcagcaatgggatcaccaacgtgtcgaggtgatgggtgaggccgccacgcgggcgcagaatgatgatttcgccggcgccggcatccgcgcccacacgcagttccgcatcgagataggtgcgttcggactcgggttcggtcatctccctatggcttgggcagatggcgatgacacggcatgggtgatcgcggcttgcctcgttggcaatgcacagtgaactttcgaggtttttctcgtcggttgcgaccacaagcgtgagcacacggccgagtgcggcctcgccgcgctcctcgtggagctcgtcgatctttgccgagatttcatcggtctgggtatcggtcaatgtcaggatcatggcatcctccaacggtgtccatcacgggcaagcatctccaccgcctcctggggcccccatgtgccggcacgatatggttgtggttggccgagcgtggaccagaaatcctcgatggggtcgaggatcttccacgacaggtccacttcctgtgtggtcgggaacaacggcggatctcccagcagcacgtcgaggatgaggcgctcgtaagcctcgggtgacgattcggtgaacgaacggccgtagctgaagtccatcgagacgtcgcgcacctccatggtggtgcctccggggaccttggatccgaaacgaatggtgacgccctcatagggctggatgcgaatgacgatggcgttcttgccgagttcctgtgtcgcggtgctgtcaaagggcagatgcggggcgcgcttgaacaccagcgcaatttcggtcacgcggcggccaaggcgcttgccggtacgcaggtagaacgggacgccagcccagcgacgcgtgtcgatatcgagtctgacggccgcataggtttcagtggtggaatccgggttgatgcccttctcctccagataccccacaaccggacgggagccctgccagcctgctgaatactgtccgcgagcggtatgcgcggcaaggtctttcggcaggcgtacggccgagagaatcttcgtcttctcatcggtcagatcacgcgcattgaacgaaaccggttcctccatggccgtcaatgcgagcaactgcagcagatggttctggatcacatcgcgtgccgcaccaatgccgtcgtagtaaccggctcgccccgccacgccaatgtcttcggccatcgtgatctgcacatggtccacatagttcgaattccatatcggctcgtacatggagttggcgaagcgcaacgccagcagattctgcacggtctccttgcccaggtagtggtcgatgcggaataccgagttcgggtcgaacacctcggagatcacgcggtcgagctccttggcgctggccagatcgtgcccgaacggcttttcgatgatcacgcgcctccaggcgtcgccgttcgatttggccagaccgcagttggcgagctgctgcgccacgagcgggaagtcacggggcggaatcgacatgtagaaggcatggttgccgcgtgtgccacggtccttgtcgagttcggccaccgtattgctcaggcgctcgaatgcatcggcatcctcgaaggtgccatgcacgaaacgtatgccctctgcaagctggttccaggtgacctcgttgaaatgcgtgcggcaatgctgctgcacattttccttgacaaattgacggaaatgatcctccgtccaatcacgccgtgcgaaaccggtgagaccgaagctcggtggcagcaagccccggttcgcgagatcgtagatcgccggcaacagtttcttgcgagccagatcgcccgtgacgccgaagatcacgatcgaacatggcccggcgatgcggggaagcctcagatctcgtgggtcgcgcaacggattgacccagggcgagtccccgggagtgtgcgttgtgtgttcagtcatagtgttcatagtaatacctgggcgggggagcggggtctcgcctgttcagcccatcgctatacgcatgtgcctgcgctatgcaaacgcatggcgaatatgcatgcggttcacgatggctggcgtttgttaaccgcattcctaggaacgcttattgcggccgattgcattgcgtacagttgacgcgatatgggccagaggcgtatggcctcgcttcgcggcaggtggcgcgagcgggcagcttgcacagatgatcgaatcgggatcgggcgtgcatgaaccggttccgcatcccgagtctgccgagagcgacacgaagtcaagccgcccgcgctcgcgtgcgaacaccgcgatctgttcgatgaaatcgcgtggcagattgctcgcgcgcgcaacctcgcccactgacatacccgattcaagcgagcggatggtgcgttctaccacaccgtccgctcgcccgctgtcggtagctgggtgtgcggccgtccgacggaaaccggtgctcaccagatgaacctcagcaactggaatgcgagcacggcgagcacataggcgatgatcagactcatgcccacggattgcatcgctatcttcatattgaactgccgtctcatctccgccaccgtggccagacatggtgtgtacgcgagcgtgaacaccaggaacgcaatggccgcggccttgccgtgccctccggatgattcgtcgaacgacgagcgcagacgggcgccaagcgagccttcgccctggtgctgctcgtcctcatcgccggtgtcgatgctgtacgattgcgccatggacgcgacaacgacctccttggccacgaagcctgtcatcaaggcggccgatgcatgccagtcgtcgaaacccgcgggcttgaacacaggggccacggtgtcggccacaacgccatacaccgaatcatgcacgtcatccaccgcagcgaacgagccggccgtcgcggtcgccggaatgctctgcagcagccacatggcgatgagcatggtgatgatgatcgagctcgcgccacgtacgaatccccacaggcgcatgagcaccgagcgaatgagcacgacgagacgcggccactggtatggcggcagactcattgcgaaaggctcggaggtcaggctcgtgaacttcaccttgcgcagcaggatgcccaccagcagaatgagcacaatggagatcacatacatgaggaacaccacaagacccgcctgctcgcggaagaatgcataggcgagcaccatgtacaccgacagtctcgcggtgcagcttgagaacggcacaagcatgcccaccatcacgcgttggcgcgaatcgggtagcgtacgggtcgcggcgagcgccggcagattgcagccgaatccgatgacgatcggcaagaaggcgcgcccgtcgagatgcatgcagcgcatcgccctgtccatcacgaaggccgcgcgggcgaggtatccggaatcttcgagcaacgacaggcagatgaacatgatgcccattggtggaatgaatgtgccgatcgtgacgatgccgtcgatgagcccgtcgacgacgagtgagtggaaccagccgtctacggtatgcggcccgaatagattgaacacccagtccacgcctgcggtgagccattcgcgcacagtgccgtccacccaatcctgggcagggccggccaataccgtggtggcttggaacatcgcatacatgagggcgaggaacacgatgacgcccaggaacgggttgagcagcacgcgatcgatgcgatcggagactgtcacgcggtcgcgtgcctgcatattgagctgtgaaagcacgtgtgcggcccagtcgaatcgtgcgtcggcattgccctccacccattgtggcacgtcgatgtcatgagggtcgacggcggtgagtcccgccggcagcggcgtgccggagaagtgagtgccgaccatatccatgagctcacgcttgccttcaccggaacggccgttcacttcaatcaccgggacgcctcccagtgtgtgtgagagctccttcgggtctatgcccgctccctgtttgcgtgcgaggtcgttcatggtcaatgcgaccacggtgggcttgccgagttcgagaaccatggcgaggaaatacagcgagcgcgagaggttcgtggcgtcgagcacggtgacaataaggtcgggattcttctccccatccaaccccatcacggtgtcggccgccaccttctcatcgggggagagcggaagaagggaataggtgcccggtgtgtcgatgagatcccatgtgttgccatcatgtgcatattcgccttcctcgagcagcaccgtagtgcccggggcgttcatcacacggctttttgtgccgagaatcgcgttgaacagcgaggatttgccgacgttcggattgccaatgaacacgatgcgtcggtgcgagccattcgctgagatgcggtgaccgccggtgtcgcagcatggcttggtatggcggctgcgatgcccgtcgtgtttgcggggcagtatggcggcgaagccgcgtgagtgctgggaatgtgattcgttgctcatatcggtccaaaccttgggaatcgtggaatttcgcagatggaatggtactcaatgcgcggtctgcgcggtggttgtggtgacatggatgctgcgtgccgtggactcgtcgagtgcaatgcgttcggtgcccttggccaccactcgccctccgaaattcgacttctgcaccacgcgtacagtcacgccgtcgcgcaagcccagctcgagcatgcggaaccgatggcgctcatcgagcgcgatggctcggatcaccacgtcggtgttgagggggcaggtctccaacgtgagggagtgggatggcgatgttgaactcatggtttcaggaaagcgcggaatggttcgcgagtcaagagtttttatgcaaaaaccaggcaataatctcagatattggtcatggactgctcagtattcggtgtgaaaagaggtggggcgtgctttcgcgcggctcgccccacctcgtatgaggccgctcttcagtccgttgtcggtgagatgacgttgccgtcggcatccacgtcacggcaggtctgtccgagttttcgcgacatggcggcgatgtcgagcagtgaatcgagttcggtgcgatcggcgtcggtgcgttccccggccacttcgcgcaccgatttgccggtggcgacggcttccttggctatgctcatcgcctgctcatacccgatcttcccattcagcgcggcacagatcgatggcgacatctccgcgtctctccgtccctgttcgacgttgattctcagtccgtcgacgcatttcgtgcggaacatgtccatggcgttgatggcaatcgtcatcgcggtgagtatctcgtgaatgatgagcgggtcgaaggcgttgagttggagctggccttccgcgcatgcccagttgacggtcacatccatgccgaagatcgtgaagcagcattggtccacacactcgggaatcaccggattgatcttgccgggcatgatcgaggagcctgcctgccgcggaggaaccgtgagatctccgaatccgcaacgcgggccggaattgagcagacggaggtcgtcggctgccttcttcaggtgcaccgcaagattcttgagcacggcactggcttcgatgtaggagctggtgtcggtgacggcggccacgggatccgaggcggcggtgatgggcaggtcggtgatttcggcgagcacggtggtggcggtgtggcggaagcgaagatcggcacagatgccagtgccgattgccgtggcccccaaattgaatacgcacagccgtttcgccaacgtattcatggcctccaagtcggtcgccaggaagctcgcccaagcgtgtatctcctgaccgtaggtcatgggcaccgcatcctgcagttgtgtgcggccgatcttgatatcgttgctatggcggtctgcctgcatgtggaatgcttcacgaagacgctgcgtggcctcgcgcaggggcttgagaccttggaggatggcgagcctgcaggccgccggataggtgtcgttggtggattgactgcggttcacatcgtcgttgggatgaatgtacccgtagtcgccacggggctttccggccagctcaagcgcgcggttggcaatcacctcgttcatgttcatgttcaggctggtgcccgctccgccctgcagcacgtcaacgggaaactggtcggcaagcgcgccgttctcgatctccagacaggcctgctctatgtgatgggccttgcgagcatcgagcatgcccaattggtagtttgctatggcgcaggcacgtttgacggtggcgtaggctcggatgagcgcagtgtgggagccgtcggcgatgccggtgaccgtgaagttgcccatggctcgttgggtgtggatgccccagtacacatcggcgggaatctccattgtgcctatgacgtcgtgctccaaccgcgtttctgcagcctgtctggtcgaatccatgctgtctgccttttcctttccgcaagcccggcggtctgcggtcccgcattcccggaggcattccatgctccgggctgacgcaaccattgtaggagcggtccgccggactggcccagagtagtattgcttacagccaacttgccggaatcacggtggaagagaggttcaatagggctatgagcaatttcgattccaatgaaaccattcagttcacgtcctcgaagcccgtctacgacttctatgtggcggggccatatgagacggcggaacaggtggagagcatggagcgccttgagaaggtgctcaacgaccgcggcatgagcgtgtaccgtccgcgtttcgccatggacgtcaacgtctcgggcccacaggcggtcttcgccaatcgcatcgccgcaatcgccaattcccgggccgtgatcgcgaatatggacgacaacgatgcaggtgccgtcttcgcgctcgcctacgggtatgcgcttggtaagccggtgtacgcctattgcgaggggattctgccgaacggtcgcatcagtctgatggtggatcaggccgccacggccgtgctcgatggccctgccgatctcgagagcctgctcgattcgggccgtgtcaagccgctggacctcgaccagcactgagggtcgaaggggccggtctgtggccggccccttccatgtccaatgtccactgagcatacatcagaattcgagtcaccccgcgccgatgtgatcgagcacgcgcaggcggcccatagcgatctcgatacacagctcatcgcattcttcgaggagttccgccgtgtcgacttgatctacggcgcgtatgggcgtcgttccggactcttgttcagcgtgtatctcattttcgactacatccgtgagaacgacggtacgtcacagcgggagatttgcgcctatacgttgttgccccgccagaccgtgaacaatgtgttcaattcgcttgtcgcacaaggattactccgattgcagggcagcaaacacgacaagcgcatcaagcgaatccacctcaccgaagagggggagcgttaccgggagcgcatgattgcaccgttgcgtcaggctgaagtgcgtgcgatgcctacactcgaacccgcagaacgtcgtgcaatgatcacctatgtcgacaggttcatgaacgcattggaacagcaaatcgacggcattgacgcctgacatgaagcattgtggtgcccagtgttctgtttcgtccacgccggtagagtgtggtgtgcgggaggcgtgcgtccacgaaaaggtggtttatgcgtctgttgccatatattccgtttattgtgccggagctcgcgattggacgggtgccgatggatgatttgactatctccggattccgtgtcgattacagacagcttggtgcctcatatgtgaatcggattcccgcattgcgctcgctcgacgaactggagttcggttcacccgtcgtgctgctgacctgagagaacgggagcgacaaatcgacgctgctggaggcgatcgcggtggtatgcggcttcagcgcggagggtggttcgcgcaactatcgtttcagcacttatgatgactgttcggatctggccgatgcgcttattctctaccgcaaacgagcgattccgccatccagtttcttcctgcgcgccgagagcttcttcacgatggccacgcaggcgcgtgattacgatcgaggtcgcagcgcgatgtctgcattgcacgagatgtcgcatggcgaaggcttcctcgagatcatgctgtcacgcaatgcgcccggcctctatctcatggatgagcccgagtccgcattgtccgccggccggcagctggcacttctggcgcatatgcatcggttggcggaacagggcgcgcagttcatcgtcgccacccattcgccgatactgctcggactgccaggggcgcagatccttcaattcgatgacgatggcgttcgtccgtgtgactacgaggacaccgatgcctaccgcatcaccgcatcgttcatcaatcatagggatgtgctcttgcgtcatctgtttacggatgaggaacggtgacatcgctgccggtaacctgtcgtgccgtggttcctcggctgatcttcgcagccgggtgtgggcgccttgtgaagagaatatgtcgattgtccactcggggacgataggggatagtctattaaatgtctcaatatgggacaatatttcagacctcgtcgaatgacgccgttttctacctattctgaggaattatgagactcatactgcgtttcatgtaaccgcacggctggctgttggcgctgacccacgtgctgatggccgccgatgtcgtcggcgctttgctggtgccgaccctggcagcgcggctgctcgacaaaggcaccgccgcgatgtcattccacgcgatgaccgtcaccgcgctgcagatgatcgccgcgtcgctcgatatgtccgtcttcgacttccgccagctcggtaccgcatcgatggtcacgcgcacgatgagcgatgtcgtgaacattcaggtggccatcacggacgtcatcatgatgatgctgccggtgccgttcatcttcgtcgttgcgcttacgttcgcgttcagtctcgacacggtgctcgacaacgaagcgaacaatctgtcggtggggcagcggcagctgctcacgattgcgcgtgtattcctcgcagacccggcgtgctcattttcgatgaggcgacaagctcggtggacacccgcacggagcaggcgattgcaaaggcgatggacgcgctgatggcgaaccggacgagtttcgtcatcgctcaccgactgtccgcaatccgagacgccgacctcattctgtacatgaagcatggcgacattcttgaacatggcacccacgagcagttgctcgcgaaagacggggcatatgcgaatctgtgcaattcgcagttcgcgtgatgctcgcgttgcccgaaacgtcggacggagatggtctctgcgacatcagcggcatcggaaccggcgccgggcgtggcatacaacgacgccgaggaggcgcgaatcattcgtgacgggaacggattgcctgccggcattcggccgaagatggtatggacgtggaagaaggcggtggcgtgggcgcttgtcgccattgtctgcgcggtcggctggacggttctggcggtggcgcgcggcgaacagatcagcgccatctggttcatcgtcgtggcgctgtgctcgtatgccatcgcctaccgtttctatgcgtattgcatccagatcaagatcatgcgcaccgacgacgcgaacgccacacctgcggagcgcgtgcatgacggtgcgaacttcgagcgggcggaccgtcgtgtgctcttcggacagcattttgcggcgatctccggagctggacctcttgtcggaccgattctggcggcgcagatgggctacctgccaagcgtcctgtggatcatcctcggcgtgatcttcgccggcgccgtgcaagacatgctcatgctgtggatctcggcgaaacgacagggccgttccttcggccagatggccactgatgagatgggcaagttcggtggcatcatcatctcgctgttcctcgtcgtggtcaccgccattgcgatggcgttcctcgcgctcgtcgccatcaaggccatggcaagctcgccgtgggccgtgttctccctgggcatgacgatcccaatcgcgctggtcatgggctgctatgagcgcttcttgcggccgggcaaggtcatcgagaccaccatcctcggttttgtgctgctggtgctcgccattgtcggcggtggctgggtcgtttcgaacccgacgctcgcacccatcttcacgctcaacgccaagcagctcgtcgtcgcgctcattgtctactcgttcgcggccgcagcgttgcagcactggctgctggtgaccccgcgcgactacctgtccacattgatgaagatcggcacattggcgctgctcgtcgtcggcatcgccgtttcgaatccgcaggtcagcatgccggggatcagcatgctggccagccaatcgaacggcccgaccttctccggcaacctcttcccgttcctgttcatcaccatcgcctgtggggcgctctcgggcttccatggcgcggtttcctcgggtctcacgccgaaggccgtggagaaggagagccagcttcgcatgatcggctacggctccatgctcgtcgagtcgttcaccgccatcatcgcgctcattgctgccatcacaatcagccaaggcgtctatttctcgctgaacatgagcgcgccccagatcgaggcgaccgctggttcggcatactccgcttccgcttcccccgaacagaacgcggtggctgccgttggcaacatgaacgtcaaggacatcgaaggcaaccagatgaaggtgacgtggcagtcccacggcaccacgtacgagggcgcggaggcattgacccaggccgcgcatgatgtgggcgaggagagcatcgtctcgcgtaccggcggtgccaccaccttcgccattggcatggccaacttcctcaagtcatacatgggcggtgaggattcgatggcgttctggtaccacttcgccatcatgttcgaggccctgttcattctcaccaccgtcgacaacggcacacgtgtggcccgataccagatcggcgacctgctgggcaatgtacgcaagctgcggaagttctccgaccccacgtggaagcccggcaacctcatcaccacgttcatcgccacagcggcttggggatccatgctgtacatgggcgtctccgacgcgaatggcggcatcaacgcgatggtcccgatcttcggcatttcgaaccagctgctcgcagccggctgcctgatgttggtgaccgtatgcgtgttcaagaaggggctgcatcggtatgcctggatcccgatcgtgccgttggtgtgggatgtcgcagtgacattcaccgcagacttccagaagattttcgattccaagctcggctattttgccgccgccgcaaaataccgcgaacagatcgcctcggggaccctcgagggtgaggcattggcgaacgcgcgtgcgtcgctgtcgaacgcctacctcgatggagcgctttccgtgttcttcttcctcatgatggccacgttcctggtcgtcggcgtcgtcgtgatcgtgaatacggtgcgggccaaggagtatggtaccgacatgtccaccgaggaaccgttcgtgcaatccgcatggttcgccccctccgggctgctcgccacgaatctggaaaaacgtgtggcccgcgaatatgcggtgcgcacgggtgcgttgccgtctaagaggtctgtggagcccgatgactccgatgacgaggtcgcgctcggcctccaaccacagctggcatgaggtgcatatggcaatgcatatatcccgatggttccgcaggatggccaggatggcagatctgacgcgccgcgtatggcgtgcgatcgtctggtatctgcgggaggtgagcggcgaggcgagatacggccgttatgtcgagcatctgcgcgccgagcatccaggtcgcgcgccgatgagcgtgcgtgagttcaacgatgcacgtgacgagtatgagcgcctgcatcccaccggctgctgctgctgaaacgaccaatatccgagcgggtgcgccccatagggcacacccgcttcctgttcacggtttcactgcaccaagccgagctctattttcagtctcaccacgcgttcggcactcgcagtgaccttggcggcaaaacccttgtccgcggcagcgcggctgcgtatgccgtccagaattggctgcgtatagcttgcggcgttcatgcagcagatgtcccctcccgcatcaatgaaccgcacgcccagatcctgtggagcaatcgagctcacggcaccggccgagagggaatccgagatcaccacgccgtcgaacggggtacctctgcgcagcatgtcggtgacgatggcgggggagaaggctgcaggattgtcggggtcgatgagtttgtaggtggccagcgacaccatcaccatggcgggtttgccctgccggatcgcagaggtgaatgcattcacctccgtgccgttctcggttgtcgtgtcgtcgacaatgccgtttgccgtgaaatcggtgttgcccctcaccgatcccaatcccgggtaatgcttgatggcactgcccacaccgccggcgcgcatgccttcgatgaaagctgcagcatgctcgccattgcgctgggcatcgagtccgaaatcacggtagagcgcgccgatcggttcattgacggcacgttcgatcgtcaccgtgtccaccgaaggagccagattcatggcgagaccggaccgtttgagggggagggcccaatcccgcgcggctgcgcgcagccggtcgagtggcatctgaccctgagccgtggcgctgggcatggcatcgaatcccggtcccgaaagatgctggaccgtgccgccctcctgatcggtggcgatgagcaatcctggcaatccggtggaggcgttcaacctctgcagtgcctgtgtggcacgcgccacgttctcgacgccgctcacccagttgcccatcaggatcacgttccccacatgctgctcctgaatcatcgcttgcaaggtggcagggtcattgccgtattgcaatgcggccatcaccaattgcccggcgcgttcgtcgaggctcatcgcctctacaatgcgtttggcccgatccgaggtgccatccgtcttgggggtgggcgaaggcgacgctgtctgcggcatggaaatggtcgtgctgggggctggcgatgatgtgcggctgggaaccgatgtcggggcggctttgccattcgtcgtgtcggaatcggtagcatggcgaaccggtgcgaatgccccaatcgcaatggcgacgattgccaatgtcacgatgacggtcgtgacaatccggaccatgcgcctgttccggttcggctgtggcttgtcgttgtgctggatcatgggtcctcggtttctgcgatggctgctgtcattgtacagttcgcgggcacagattgccgccggtggggcgccggatgccacgctgaggagcgtgctacgcgcgaagcgcgcagacaccttgacgaagcgtggcatccggcgccccaccggcggcacccggagagcctacgcctgtcagggggaaggatctggaaatacataggcaaacgtgtaggtacagaagagaaaccaagcacttcctccaacgcccttggtcggggagaggttcattggtagaatggccgaatgtctttcttcgatccattcttcggtgccgggcatggcacccggcgatcacaatcgcaatcgaatgacgacgatccgatcgtcatcaacatcgagaccgacggcgagcccccgcattcgaatgctgcaggcggcaacggcacgccccgctctccgcgcatcactcgcaagccggcgaaaccccatggcaaccacgggcgccgggtggccattgccgtcgtcgtggccattgccgtcatagtggcgttgttcttcgcggtctcgtcattcgcagcagacgtcatgtggtattcgcagctcggcttccagagcgttgtctggacgttgctcggcacccgtgtgggcctatgggtgttctatgcggccctcatggtgctcgtcagttacattgccgccactctggccattcgtgcacgtcccgatttcgccgatggctccacaatccgcatcaacggtgacaccatcgagatcggcaagagcgtgagctcgcgcactgctcgccgcgtggcggtggtcatctcgctgatcgcgggcatcattttcggttccaaggtcaatgcgaactggaccgagattctgctcatgttccacaaccagagcttcggctctgtcgatcctcagttcggcttggacaacggtttctacgtattcgtgctgccgggactgcgcatgctcgtctccgcgttcacactgctcatgttcgtggcgctggtgttcagcgtggccacgcatgtcgccatgggcggcatccgcttcacgatgccggtgcatggccacggtttgttcgccatcacgaagcgtgcccgtcgccagatcggcatctggctggtgctgtggatgctgtcctgggcagtgagccaagggctctcggtcttttcatcgctcaccgcacagggcgatcgattcaccggcgccaattacacggcggtgaatgcgggcatccccgtcaccgtcatcatggcggtgctcacggccgtcctcggcgtggtgctgtgtgtgtggctcatgaccacccatgtattcgacgacgccgtatcgcgtcccacggcgaatgcagccgccgcatggcgtgaatggcgcgtgcccaccatcgccgtggcgtccacgctcgtcgttggcatactgctgtccacgctatggccgatgctgctccagcggttccgcgtgaatccgaatgcacaggagatggaatcggcatacattcagcgcaacatcgatgcgacccgtgctgcctatgggctggatgcagtgaagaccgacgagtacaaggccaccacgaaggcgcaggcgggtgccctgcagaaggacgcggagaccacggcgcagatccgactgctcgacccgcagatcgtctcgcctacattcaagcagcttcagcagatgaagcagtactatacgttcgccgacacgctggcggtcgacaaatatgacatcgatggcgtcaatcaggacacggtgatcgcggcccgggagatcaacctcgagggcaacgacaaccgcaattgggtgaacgaccacaccgtgtacacgcatggctatggcatcgtggccgcctacggcaacaaagtgaccagcgacgggcagccgcagttcttcgaatacggcattccgacacaggggtatctcaccgacacccagcactacgaaccgcgcatctacttctcgccggaagcacccgagtattcgatcgtcggcgcgccacagggcacgaagtcctgggaattcgactatccgacgggttccgagggagccaccaccaccttcaatggcaatggtggcccgcgcatcggcaacatcttctccaggctcatctattcgatcaagttcggttccgaccagatcctgttctccgaccgtgtgaacgcggattcccagattctctacgatcgttcccccaaggaacgtgtcgccaaggtcgcgccgtacctcacccttgacggacgagtgtatccggcggtggtggacggccgggtcaaatggattgtggatggctataccacctcgagcaactacccgtattcgcagaagacggaccttgccgaggcgacgcaggactccaccaccatctcctcccagacggtgcagggcctgacggacaaggaagtcaactacatgcgcaattcggtgaaggccaccgtcgacgcctacgacggttcggtggacctctacacctgggatgactccgatccggtgctcaaggcgtggcagagcatcttcccgggccaataccacccgatgagtgagatctccggcgacctcatggcgcatatgcgctatccggagggcatgttcaaggtgcagcgtcagctgctggccaaataccatgtgacctcggcctcgcagttcttctcgggcgaggacttctggcagaccccggtcgatccgaccgaatcgaagagcgagcagtcccgcgatgtgctgcagccgccgtattacctcactttgcagaccggtggttctgacgaaccggtgttctcgctcacctccacctatattccggcgggttcgagcacccgtgagattctcaccgggttcctgtcggtggactcggacgccggccgcaccaagggcgtcagagggcccgattatggcacgatacgcctgcaggagctgccgaaggattccaatgtgcctggacctgggcaggcgcagaacaacttcaatgcgaacgccgatgtgtcgaaggagctcaacctgctcgaatccggctcgacgcaagtggaacgcggcaatctgctcacgttgccgctgggcggtggcctggtctacgtggagccggtgtacgtgaagtcctccggcgcaaccagctacccgttgctcaagaaagtgctcgtcgccttcggagaccaggtcggtttcgccaatacgctcaacgaggcgttgaaccaggtgttcgatggcaattcgggtgctcaggccggcgatggcgggaatcaggggagtggcgggaatccgtccgattccggtgcggccggcgacaatgcggacgggtcgggctccacagcgaatacaaatcggaatcctgagctttcgcaggctctgcaggatgccggaaaggccatgaaagacgccgactccgcaatgaagaagggtgactggagtggctatggagaggcgcagaagcgtctcgaagaggcactcgacaaggcgatggcactcgacaagtgacatgatgccaatcccatgcccatgcgtgaggggcgcggtcctgtggccgcgcccctcacgcatgggcaggatgtgcgcggtctgctgtgccgatatgctggaaccatgcagcaattcagatatcgccttgccacggtggatgacgttgcggtcatcaccgacatctataacgaagcggtgatggccggagggtccacggccgatacggtgccggtcacgtatgaggcgcgtcggcgatggattgagtcccacgtcgatccatatgcggtgttcgtgttcgagacgattgccggcgacggtgaggccgaggaggtgggattcggcgccatatcggtgttctacgaccgtccgggttacgacggcgtatgcgatctggcatattatgtgaccgcacgatggcagcgcaggggagtcggcagattcgcactgcgcacgctgctgaacgaatgtcgcgcgcgtgcgatgcgcaaggcctgcgccatcatcttctccgacaatactgcgtcgaacgcgctcgtggagtccttcggctttgagccattcggtgaaatgcccgaagctgcgtatgattccagaggagtgctgcacgacatgagctattggtgcctcgatctgaccccgttggacgccaagggcgcagtagagggcatcgcgcggcggtgacggcaacgaggactcaagaggataccggaggataggagagcacatggcaagcgaattctggctgattgtgggattgggcaacccgggggcgaaataccgcaacacccggcacaacatgggattcatgacggtcaacgagttggcgaagcgctggagcatccatttcgccaaccacaagggacttgccgatctgggcaaaggcacgatgagtctcaacggccagacggcgaaagtgttcctgtgcaagccattgacctatatgaacgattccgggcaggccgtgcagtcaatccgtgagtactaccacatcaatctcgaccacatcgtggtgattcacgacgacatggacctcgaattcggccgtatcaaattgaagtccggtggctcggccgggggccacaatggcatcaagtcaatcgaccgttgcctgcattcccctgattatgcgcgtgtgcgcatgggtgttgggcatgccagccgatccggcgacgcccacgacaacacgatcaactgggtgctcggcgaattcaatgccgcacagcgcaagcaacttcccgagttccttgccgacggtgcagatgccgcggagacgatcgtattcgaaggcctcacgaaagctcaggataaattcaatgcccgatgacaaggcaaggcacagcaatgcgaaccgatcggcggaggagacctacaacgagctgatgaacggttcgctcctctccctcaggcagcgtcttttggaggatcaggcattcgccggtttggtggaaggccatgtggatgcgggcgaggacgccgacccgagcatcctcgtcggagctcccaacggcattcgtccagcactggccgccgccagtgcggaccgtaagccagtggtcatcgtcgtcccctccggtcgcgaggcggaggatctcgtcggcgatctgcgatcgtggtatgacggcgatccgaatgaggtggcacagctgatggcatgggagacgctgccccacgagaggcttagcccacgcgccgacacggtggcgaaccgcatggagacgttctaccggttgtgccacccgcagtccgacagcgagatgttcggcccgatacgcattctggtcatgccggtgcgttcgctcatccagccggtggtggctggcataggtgacgtgaagccgctcgttttcgcgcaaggtgaggaaatcacccttgaagatgccgtgcagggcctcgtccgcaattcctatacgcgcgtcgatctggtgatggaccgtggcgagttcgcggtgcgtggcggcatcatcgacgtgtttgttcccaccgaaccgcatccggtgcgcatcgagttcttcggtgacgagatcgacacgatccgccgcttccattcctccgaccagcgcacctatggtgaaccgatcaggtcggtgtgggccacaccatgccgtgagctgcaactgaccgagggcatacgagagcgtgcgcaatcgttgatcgggcagattccgaatgccgacgatcttctggaatcgatagccaacgcaatcccgcaggagggcatggagtctctcatcccggcattggtggacgacctcgaaccagtttcgagcatgctgccgagggattgcatcgtaatgctgttcgacccggaacggctgcgtcgtgcagtggatgacctgatgaagacggcgaacgagttcctcgccaccagctggcatgtggccgcatcgggacatggcgcgggtgcgccgatctccttcgaagccgcgaacttccttgatcttgatgaggtggtgggccagctcacctactctaaccatgagctatggaaggtgagcgggttcactgtggaccagtcactaccggggcacgtgcagatcgatgcggtggcgccacaggatctccacggcagtggcgagaaggccgaagaccatctcggcgagctcattcgcaaggattacgcggtcgttatcacagccgcggcacagggcacgctgagccgcctcaagcgcatgctcaatgagatcggcgtcgtgcatttcgacacgattcgttcgcaggcgcaagacggttttatcgaccacgcgtcgaagaccgcgttgctcaccgagcgcgacctcaccggccgcaccagtgtcgccgcaggggtcaagacggcacggaaacgacgcaaatccattgatcttatggaattgaaaccgggcgatttcgtggtgcacgaacagcacggcatcggtcggttcatcgagatgcgccaacgcacaaccggctcgggcaagaaccaggccacccgcgagtacttggtcatcgaatacgcgccgagcaagcgcaatgcgccgccggacaagctgttcatacccaccgaccagctcgatcaggtgagcaagtacatcggtgctgagattcccaagctcaacaagctcggcgggtcggattgggcgcagaccaaggcgaaggcgaagaagcatgtgcatgagatcgcgcagaacctcattcgcctgtattccgcgcgtcaacgtgccaagggattcgcgttcagcaaggacaccccgtggcagaaggagctcgaggacgccttcccataccaggagacggcggaccagctcaccacgatcgacgacgtcaaggccgatatggagaaaccgattcccatggaccgtctcatctgcggagacgtaggcttcggcaagaccgagatcgcgatccgcgccgcgttcaaggcggtgcaggattccaagcaggtggctgtgctcgtgccgacgaccctgctcgtgcagcagcatctgcagaccttcaccgaacgttttgagggcttcccggtgaatgtacgcgccatgagccgattccaaagcacgaaggagatcaatgagacgatcaagggtcttgccgacggcaccgtcgatgtggtgataggcacccataagctgctgaatccgaagatcaagttcaaggacctgggccttgtgatcatcgacgaggagcagcgttttggtgttgaggcgaaggagacgctcaaggccgtacgtacgaatgtcgatgtactgagcctgtcggccacgccgattccacgcacgttggagatggctgtcacgggcattcgcgagatgtccacgctggcgactccgcccgaggaccgcctgcccgtgctcacctatgtgggcgcctatgaggacgcgcaggtcaccgcggcgattcgacgtgaactgttgcgcggcggtcaggtgttctacatccacaaccgtgtcgagggcatagaggagaaggccaagcgtctgcaggacctcgttcccgaagcccggataggcattgcccatggcaagatgggacgtaagcagctcgaccagatcatccgcgatttctggcatcgtgacatcgatgtgctgctgtgcacgacgattgtcgagacgggtctggatatctcgaatgcgaacacgctgattgtggatcgtgccgaccgattcggcctctcccaattgcaccagctccgtggacgtgtcggccgaggccgtgatcgtgcctatgcctatttcctgtacgatccgagcaagccgatgaccgagcagtcccacgaacgcctggtcaccattgcgcagaacaccgcattggggtccggcttcgacgtggccatgaaggatctcgagttgcgcggcaccggcaacctgctgggcgatgagcagagcggacacatcgaaggcgtgggcttcgacctctatgtgcgtatggtgagcgaggcgatcgaggattacaaggatccggaacgcacggaaccggttgcggtcaccatcgacctgccgatcgaggcatcgatacccgtggactacatcggttccgacaagctgcggctggaggtctaccgcaaactggccggtgcccgcagcgagaaggatctgaacgagttgcgcgacgaactgaccgaccgctacggcaagccgccaaaggtgttcgaatcattgttcgacgtggcgcgtcttcgtgaaaaggcacgcgcgcttggcatcagcgagatcatcggccagggcaggaagctgcgcatctcgaagatcgaccctgccgaatcggtgcagctgcgcatctcgcgcatctacccaggtgcccaataccggcccatgttgaacgcgtacaccatacccacgccgttcgaaggttcgatgggttccggtccgatggaatcggatgaggtgctgcgttggaccgagcagctcctcgacgatctagcgtggtctgcaaagcctgtgaagtagcggcggaagggtttggatgggtggggcctgagcggggcgtcgtttcgtcgaggtgtctgcatggcggggcttcgctacgccggcagcacgctcctcaacggcgcctcgctcaggccccacccatccaaacccatcgaatctctccgcagacacgcgcacgcacagacggtgttattcgtgaagcgcgtcgtgcagtcgacgttctaatgcggcgaaatcagaaggccggttgtctgtgtccacttcggtgcgatcgatacggagttcctcgcggattgtgccgtttcgcagcacgagcacacgatccgacagacgcagggcctcgccgatgtcatgtgtgaccatgatggtggcgaacccgtgttcgttccgcaatctgagcaacaaatcctgcatgtcccaacgggtgagggcatccaaagccccgaatggctcatcgagcagcagcaggttcggctgacgaactaatgcgcgggcgagcgagacccgttgcatctgaccgccggaaagcgtgtggggcagcacatcagccatgtccggcaactgcacgtgccgcaacgcgagcagggccgcctccttgcggaacttgcgcctggtgtcaatccccaatgtgatgttgtcccataccttgagccagggcacgagacgggcatcctgaaagccgaaggcgtactcgccggaaacatcgatgcgccccgaatccggcggaaccagcccggcgatcatgcgcaacaacgttgatttgccgcatcccgagcgtccgatgagcgacacgaattcgccttggcgaatcgtgagggtcacattgcgaagcacggggcgcccgtcgaacatcttggacgccgagtccatgttcacaactggtgccatggaaacactccctttccaattcgaacaacctgcatatgccggaggctgtgggggagccggccgggaagcattgctgaggagcgtgctgccgacgcagcggagccgcgccatgcagacacctcgacgaagcaaggcttcccggccggctcccccacaacctccgatgaggcaatcaggccgagcaatccattgacgccgcctgcaagtccggcattgcgtcaatgaatccgaaatcgacatactcctgcgcctgggattccagcatcttcaatccctctgcatcaatcggcttgatcaccggcacattgaaccttgcgatctgttcggtcacgtcatcggatgcgccgaattcccggtatgcgtcggtgatgatcgacggcgtggcctgcgccacgtcggattccctgacgagcgcccgatacatcgctttcaccgcttcggggtgcttggtggcgaaatccttcgacaccatatgaatcgagacgttcttattcccgtattccgttgcgttcacgagcagtttcgcgcccggggtcgccattgcggcggccagattctggtcgaaggaactcaatgcgtcgatctgtcccgaagtgaaagccgcctggaaattggaggggctcatctcgacgatgttcaccctgcctacatcgagtccgtcatgctcgaatgccttgtgcagcacgtaatcgccggtgccgccgcgttttatgatcgcaacgttcctgccgtagaggtcttcaagtgagttcaccccagatttcggcgaggccacgattccttgcgaatcaccggtgtaatactcgatcgcgaaggccacccacggttggccttgcgccacgaagttgatgtacgagccggtgccggtgctcgtggcatcggcattgcccgacagcactgctgagtatgcatccgtcgggttgtatgggccggtgaatttgacgttggtgtgctgcatcgtctcgtcaagaaagtcttcgccgcgtacggtggtcaggtaattcgcggtcgacagataggccacgcgcatggtcgtggaggaatccgcggcattcggttcgccgcaggccgagcatgacagtgagagcaacgctgcgcatgcggcggacgtgaatctgagcatggtggatcgtgacatgattctccttgtttgggtgcatatgggtgtacccatatgtctcatgggattggtcattgtaagggtgaacctgattgccgctatatggagtatcagtgtgcgcatggaacgacgagccgttccaatgcacccaccagccattcgctgaacagccccaggaatgcatagagcacaatgcacagcaccatctggtcggtccggtagaactgctgggaacgcgagagaatgtagccgatgcctgccgaggaattcaccgtctcgcaggtcaccaacgcgatccaagacacggtgagtgcgaacctcagccccgtcatgaagcgcgggagcgtgccccgcagcaggatcttcgcgaacacggtgcgtttgggcaggtggtatgcctgcgccaattcgagcagtttcggatcgatgccgcgcacgccgtcgcgcacattcacatagatcagcgcaaacgcgccgatggcgatcaatgccaccttcatcgtctccccaatgcccaacagcacgatgagcagtggggagagcgccgggaacggcacggccctgagcatgtgtatgggcttgtccatgattgcatggccaatggtgcttgaccctgcgatgatgccggctggcaccgccgtcacgacacccagggccacgccgagagacactctgtagaggcttacgcctatggatggcagcaacagcccctcgctgtgcaacgcaaggagcgcctgccacacttcgccgggggagggcagtgaacggttgtgcgccggtcctccggtggccaaggcccacgcgagcacgatgagcaccgtggaagcccacagcgcgcagaagcggggtgcgcggccatgatgccacggaatgaatcgcgtgccgatccggctcgcagtcttggtatgttcggctgcgggcacggcgtatgcggcggagcgtgccggtgcaccggtcgtgcccatcgaactggcatcccggtaagggttcccggactcgttcgttgcagactgggtcatgacattcccttcgatagcattgtctatgtcaggttcaacgagtgtgatctcagcccagccgacccgctttggcgtcgcttccagcatgtttgaaggtcatggcccgggcaccccgtgtcgctgttcacgttgtcggaaggctcggacaatacgcgtgtcgcagtcgaaaagagtcgtgggagcgctcacattttttctgatccgctcccgccaatcgtccaacaatctcattacgctggaaactgtcatcacaacctatgcacattaaggagaagttgtggcagcaattgaaagcgtgtacgcacgccagattcttgattcccgcggcaacccgaccgttgaggtcgtgctcgacaccgatgacggtgctcgcggcctgggtctcgttccctccggcgcctccaccggcgaagccgaggcttgggagcgtcgcgatggcgacaagtccgtctatcagggcaagggtgtcctcggtgccgtcaaggcggtgaacgaggagatcgccccgaaggtcatcggcatggacgccaccgaccagcgcgcactcgatgacctgatgatcgagctcgacggcaccccgaacaagggccgtctgggcgccaacgccatcctcggtgtctccctcgccgccctttatgcggccgccgagagcgccgaactgccgctgtaccgctatatcggcggcaccaacggccatgttctcccggttccgaacatgaacatcatgaacggcggcgcacacgctgacttcgccaccgacatccaggagtacatgatctccccgtacggcttccagacctactccgaggctctgcaggccggcgtcgaggtgtaccacaccctcaagaacgtgctgaagaagcagggtctggccaccggtctcggcgatgagggcggcttcgctccgaagatgaagaccaacgaggattccctcaagtacatcatggacgccatctccgccgccggctatgagccgggcaagcagatcggcatcgccctcgatgtcgcctcctccgagttctacaacaaggagaccggcaagtaccacttcgatggtgaggaccgtgattccgagtacatgctcgacttctacgagaagctcgtcgaccagttcccgatcgtctccatcgaggatccgttccaggaggaaggctgggaagactgggccaagatcaccaaggcccttggcgaccgcctgcagttcgtcggcgacgatctgttcgtcaccaacccggtgcgtctgaagaagggcatcgatatgggcgccggcaactccctgctggtcaagctcaaccagattggcaccgtttccgagaccctcgacgccatcgagctggccacgaagaacggcttcacctccatggtctcccatcgttcgggcgagacgccggacaccacgatctccgatctcgccgtcgccaagaacaccggccagatcaagaccggcgccccggcacgtggcgagcgcatcgccaagtacaaccgcctgctcgagattgaggaagagctcggttcgaccgccgaatacgctggctacagcgcattcaaggcatgccggaagtacatgtgattcgaaacgcattctggtttgaccgggtgacccgtccttagggaccttattcgctaatacccgccgcacgtcgaatgcggcgggtattttcgttcctatgagcaagcggccacatgtttcgaaaccacagtctgcgccctcctcgtccaagaaggagcggacgcacacgaagggagcgaacaccggccccatcgcattcttcatcgcactgttcgtcatcgcggtgggctccatccagatcatctccgcattccacacgtatgcgatcaatctgagcgagctgaactcgctcaagaagcaggaagccgtgctcgcggcgcagaagaaggatctcgaaaacgacatcgcccgctgggacgaccctgcatacgtaaccgcccaggccagggaacggctcgggtatgtgttcccaggggagcaggcgatcaaggtggagcatcccgaggcggtgagcggcgaacagccgaagtccgatgccaatgcgaacacggaaacgggccaatcgaacctgccctggtacagtgagctcgcctattcgttcaaggaatcggatgccagaaaacccgatgccaccaataatggcaacaccgccgaatcgcggcaacagaatgaccctgatgccaccgcgggcaccgatgccccgcaggatggcggttcggcagggcagtagcgcattcgacatacccacacaccatgcgggcgatggcccgttcgattccctgaccaagatcggaaggaagcatgagcaaagaaggccggaacgccaacggcatagagacattggccgcagagacattgcagcgggtcatggagcacccggcgacgcagaatgacatcgccaccgtcgagacccagcttggcaggtatccgcgtggcatggtggctgtcggagcacgttgcgtcggggacggcaccccgctggtggtgatcacagggcctgtattgcccggtggcattccattccccacgaccatgtacctgaccagtccggaggcggtgaaggccgtatcgcatctggaagccgatggactcatgagacaatacaacgaaatgcttgccgacgataccaatctgcgtgctcaatacgagagggcgcatgccgcgtacctggcattccgccacggtcttgccgaacggctgaatgagagtgaggagcacatcgaaggtataagcgccggtggcatgccggtgcgtgtgaagtgtttgcacgccttggtggcacagtcgctggtcatgggccccggcgtcaacccgatcggcgatatggcattggaacgcatgcgcaatgagttcgatccgacggtatgccgatgtgtgcgggcgcaatccgacggacaagagacacgctgacggcatcggccgtatgcgtgactcgagagggaggtagagatgactgcagtgacagtggccggaatcgattgcggaaccaattcgattagactcaaaatcgcgcgggtcgacgagcatggggtcactgacgtcgtgccgcgaatgctgcgcgtggtgcgcttggggcagggtgtcgacgagactcaccgcttctccgatgaggctttggaacgcacctatgccgccgttcgcgaattcaaggacgttcttgatgagcatgcggtggacgccattcgcttcgtggccacttccgccacacgcgatgccgacaatcgcgaggaattcgagaacacggtggaatccattctgggagtccgccccgaggtgatctcgggcaccgaggaagcggacctgagtttcctggcagccagcagtgccatttcatcgctgcctgacgtcgaggccccatatctggtggtcgatctgggtggtggttcatgtgagctggtgcttggtggcgatggcgatacgcttccagctacgaaggtgcaggcggcgttctcgatgaacattggctcggtgcgtatgaccgaacgccatcttcatcacgatccgccgaccgagcaggagatcgacgaagcagttcatgacatcgacaggcatatcaccgaggcattccgacatgtgcctgccggcaggacgcatacgatagtcggtgtctccggcaccgtgaccacgatgacggcactcgccatgggactgaccgaatacaatcatgtggctgtggacggtgtgcgcatggacttcgaaaccgcgttcgccgtcgatgatcggttcctcaatatgacccgtgcggaacgtgccactcataagaccatccatcctggacgtatcgacgttgtcggcggcggcgcgctggtgtggaaccgtgtgcttgcccgcgtggccgaggctgcattgctcgaccacggccagcacatcgattcctacgtggccagcgagcacggcttgcttgacgggctcatcatcgatctgggtcgcaggacgcttgagacctgcaacgagcgccctacagaacactgaacaccgatatggcgcactcccgtgatcgacgtaaatcaggtgagtgtgacataatgtctgtctcgggacgcgtgcgccccgaagcccctgtggcgaaatggtatacgcagccgacttaaaatcggtcgcttcggcttgcgggttcgagtcccgccaggggcacctcctcaccagacacggcatgcagtacggccatatgtccgtactgtgagaaccttgtggttcttcgcatgttcgaaaactgcctgatacatctgttccctacactcatatgacagatcacgctccagggcatgggaggaacatggcatccaagggaaccgcagtcaaggcatcgaatacgcacgagtccacagtcactcctgcgggtagctccgtccaagtgcacggggagagtggcatgccggtcatgctcgtgcaggccatcatcatcgcggccacgctatgtgtgtgcgaactcgtatgctcaccgatctacctttcattcacacccggtctgttcccgattggttcatgggtgcttgtggccatgttgctcgccgtcgcgttcgcatatgtcgtgggcttcgcgctgctgtggtgcgctgaatcgttcgcctaccgcatgaagcgcaaactgcagccggtcgtctattcgcttatcggtgccgtcggcttcgccgtgtggaccatttgggtcgtgctcggattcatgaacatgatcgcggggccggtgctcggccaaaccgtgtcgcaccatgacaccatagtcgccggtgtcaatggcgcgatgctcgggtttgcctcgttcttcttcgcatccacgctgggtgagcgcctcgccaaatacacgaaggtgatgatcgccatcggtgtgatcaccgtattgctcgccatcgctggaggcttcctattcgcggcgatgtaccagtccgtgcatgcctgatcccctctgaaccggcttgtcgctcgcagacgcgtgtacaatgccgtgtgtgttcagtgtgctcgatatgttctccgttggtgtgggcccaagctcatcgcataccgtgggccccatgctcgccgcacagcgtttctcgaaggcgctcgcagacgggcatctgcttgcccgtgtgacccgtgtgcatgtcacgctctatgggtcgttggcattgaccggactcgggcatggcactgaccgtgccgccgtggtcgggttggaaaacaacgagccgaagacggtggatacggattatctcgcgcgcatccatgagatctgtgatgagcgtggcacgttgaatctgaacggcgaacacgagatcgcattcgaatatggacgcgatatcgagttcgaccactggcgacgtttcgccgcgcatccgaatggcatgcggttcacggcatatggcgagcacggtgagcaactgctcgaacaggtgtggtattcgatcggcggtggattcatccaacgtggtttggccacggatccgcttgtgccgattcacgcggaagtccccccagccgtgcagcgtgattccgaggagcagatgagcgagcagaccgcgttgtcggtggaaggtgacagcatggctgggctgccctacccattctccacggcgtccgagctcatcgacatatacgtacgtaccggtttgggcatagacgaggtcgtctgggcgaatgagactgccatacgacctgccgaacagatcgaccggcatatcgaaacggtgttccgcacgatgcgcgactgcatccatgaaggatgcaccagccggcaagcggtgctgccgggtgggctcaatgtgccgcgacgcgcacccgccatgtatgaccggcttgcgggcagcggagacctgctcaatcagccggcggccgacagcgtgcgggagctcgagtcgtcgaacgaggcctgggttgatttgttcgccctggcagtcaatgagcagaacgcggcgggaggacgcatcgtcaccgcgccgacgaacggttcggcgggagtgattcccgcagtgctcatgtactattggcatttcatcgcgaatgcgaatatggcgggggtgaagaagttcctgctcaccgcatcggcaatcggatacctcatcaagcgcaatgcctcgatttcaggagccgaggtcgggtgccagggggaggtgggatccgcatgctccatggccgcggctggcctgtgcgctgtggtcgggggaaatcctcggcaggtggagaacgccgcggagattggcatggagcaccatctgggactcacatgcgaccccatcgccggattggtgcagattccatgcatcgaacgcaacgccatagcggcgaacaccgcgatatccgcagtgcgtatggccatgctcggcgatggtacgcatatcgtcaccctcgatcaggtgatcaagacgatgaaagacaccggtgaagacatgatggcaaaatacaaggagaccgccaccggaggcctcgccttgaatgtggtggaatgctagcgcctgcgtgcggcggtgaatgaaatgcgcgcatatgctaggacgggggtatgctaggctgtggtattccgagcaaaggagactgatatggcaacagatatgcctgtggtcaagggagcattcggcgatacgccgcaaatcgaattcccgagtgagcaggccccgcaggggctcaaggtcgtggagctcgaagagggcaacgggccgattgtacgtcgtggcgacacggtgaccgtgaactaccatggtcaggtgtggggcaacgacaaggcgttcgattcaagcttcgaaaggcaccatccggcgagtttcggcattggcgtcggacaggtgatcaagggttgggaccagaccgtgccggggcacaacgttggttcgcgtctgctcatttcgattccgccgcaatacggctatggggccaacggtgcgcctcaggccggcatcggcggcgatgacacgcttgtgttcgtggtggacatcatctccacgcgctgagcgaacgggttttcaagggcaccggtggaatgccggtgcccttgctgtacaatggcggcataagccgcgtcatatggagggtcatatggaacaggaagaaaaggtcgtgctgctcacgcaggaggcgtacgacaagatgaaggaggagctcgctcatcgcgagggtgaataccgcgacgagatcaccgaacgcatcgccgcggcccgcgcagagggcgacctctcggagaacggcggatatcaggccgcgcgcgaggaacagagcaagaatgaggggcgtatcaacgaactcatcgtcaagctgcgcaatgctaagatcatagaggcgcccaaggccggcgaggtgggcaatggttcgttggtcaccatcgagttgggtggcaatgagatgcagtacgtgattggttcgcgtgacatcacggtggccaccgattacgatgtgattagccctgagtcgccgattggcggtgcaatcatcggccacaaggtgggggatgtggtcacatacaaggcgccgaacggtcgtgagatctcggtcacgatcaaggaatccgagccattgaattgataccgggaatatggcagggcccgcgaacacatgcatgtgttcgcgggccctcccatattcccggctggtagagaggcccgtcaggcgagggcggccagatggcatacgaccaagtagatggccaccacatggcaggcatacccgaacacggtgccgatgtggaatatctcatggaagccgaacactttcggccatgggtcgggccaccgtttggcatagacgacggcgccggcgatatagcatacgccgccggcaagtagcagccataccacagcaggaccggccaccggtgacgtccagaacaagcccatgaacgccacgccggagacgccgaagatgatgtagaccggcacatagagccaacgcggtgcattgatccacaccacatgaatgatcagggcgatgagtgtgcaggaccacatgccgatgatgatcgccttgcgccagaaatcgtcgagggcgaaggagacaggcgtataggtgccggcgatgagcaggaagatgttgacatggtcgatgcggcgcagcacgtcggtgaccctgggcgaccagtcgccgagatggtatagtgcggagttcgtgaacaggaatgcagaggatgccatgaacacggcgcaagcccatttgagtgccgccccatgggccagacagatgagcacaatgccagccgcgatggccaacggggcggcgcctgcgtgaatccaaccgcgcatggcgggcttctctcgcccatgcacatcgaggcggatcttgcgctcgatttcccgaggtgcgattccctcgagcttggcggcctgctcctcacccttggctatcgttctcttcgccttgttgtcggccttgcgacgaatcttctcggccttggcatgcgctttcgtacgcaccagattcgccttcgcctccaatgcctgttcacgggcctcgatcacggctgcgcgcttgcgttcgacttgctccggtgtcatatgccgtctccttcctacctccaatcctacgctaccgtaagttacgataccgtagcataatgacaggtggcacgtccttacactgcgtatatgcgtagctgttcttgtgcgcgttgctggctatgatgaagccatggctgatttttcacagatactcgcgacgcgaccggatttcgacgacagcgatcgggaatggcttcaccatttggtggcggattggcaggtcatcgccgacctgagcttcgccgatcttctgctcatcctgcagaaaggcgatggaagctatatcttcgccgagcagtgcaggccatccacggtggtgagcatgcgggtggacgatgtggtgggccagcaggtcgatgcatggatgaggaacgaatgtgaggccgccatgcagcatgatggcgtctacaggtcgcagaatctgcagcatatcgatgggatgaacatctgcaacacctatgcgcccatccgtcacaacggtaagaccttgggattggtgctccgcgagacgaatctggagaaccgggaatccaatggccggtatgaatgggagagtctggaggtggggcgccagctgttcgccatgatcacccgcgagcagttcccataccgcgatgccgtgatgaaccaacggcataatgcacgtgtgtccgacggcttcatgcgcctgacggtggatggcgacgtcacgtatgcatcgccgaacgccatcagctgtttcaggcgtctgggtatggtcgacatgatgcagggtaagaacctcggtgaggtgggtgcaggtctcattcaccagaacgatccggtgccggaatctttgccgttggtgctgttgggcaaggcgccggtggattccgaactcaatgcgaatcactcagtggtctccatccgttctatgccgttgatggacggccatgggcgcacgggcgccattgtattgtgccgtgacatcaccgaactgcgccgccgggaagtggagttgcagacgaaggatgccacgatttctgaaattcaccatcgagtgaagaacaacctgcaggcagtgtctgcgttgttgagactgcaggcgcgtaagacgaagtcccaagaggtgaagaaggagctgcaagaggccatgcgtcgcgtgcagacaatcgccatggtgcatgaggggctcagccagaccgccgacgagaacgtggatttcgacaaggtgatttccaatctgctgcgcatgagcgtcgacctggcctcgatgcgggaccaacacatcaccatcgacttcgtgggcaaattcggcaagatgcccgcgcaggacgccaccccgttgtcgttggtgctcaccgaactcattacgaatgccgtggaacatggttacgatgggcgcaaggaggggcacatcaccgtatcggtggggcgtgagggcaaatgtcttaatgtcgtggtggaagacgatggcaacggcatggaccaggaggagagcaacggcatggccaaggcctcaggatcaggccttggcacgcagatcattaacactttcgtcaccaacgacttcggtggcaatgtgcgctgggaacatgggcgtgatggtggcaccagagtgattctagacatgacattgcgtgcggcctgagatgacgcatcccctatgcgcaaggtgcccggcatccaattggatgccgggcaccttgcgcataggggatgcgaacgcagaagctcagatctgcatctggagcgactgggagcgacgcgcgcgcatggcgcgtcgcttcaaggcgcgtcgttcgtcctcactcagaccgccccatacgccgtaatcctgatttgtgtcaagggcgcatttgaggcaggcgtcaatcaccttgcaggtgcggcacactgctttggcctcttcgatctgctggtaggccgcgccggtgttgcctacagggaagaaaagctccggatccttatcacggcatgcagctttggcacgccaatcgaaagcactgctcatgtcaatcctcacgctcgagtggtaacgctaaatcgctatactatgcaaccgtcatggatttttcaagggtttcgatcaaaaggcggaaaatatcatgttcccgacctgtctcgtatgcactgaataagtcgggcacacccttgttccagcagcacggcgcgaccgggcctcatgaactcggaaggcgcatggtccgcaagcatgtcggcggggatgccatccgcaagatcggcattcctgtctccgcaggcgaacacgatgcgtacggacgcatggtcgggaatgcgcagtgggcgtgaggtgcgcaggctgaacacggtgagcgtggaagtgtctgctatgctgagccgcagggcattgtcaccgctcatatacttcatcggttccaaggcctcatccgcatcggggaaacagtccaccggtgtgccgtgacgcatggcctcccgccggatgcgttcaagcagtgtatgcgcaccgcggtgtggcggtgcgatgatggcgacggaaccggcacaaaggtcgatgaaggccggttcgaacgagacgccagtgtctgcgacgccaatgagtatacgtgaggcatcgctgcatgcgtcgatgtgcatgcaggacagttcatcctcatcgatgtccgatggcaacggaggagtgaacagcatcgcacggttcgtctgaccgaaaaaacgggcggattggtgtatctgcacggtcaatgccccgatattcgaaggctgcaaacactgcaatatcacgcactcaccctcatggttcagcactgccgttccgggacaatccacgggaatggtcgaagccagtgccgatccgatcatctcatgggattgcatggcatcctggactcgaagacatatgcgcagactcatattggccttcatcgaggcgttgatctccaccatcggattctgcgtgcacaccaccagatgcatgccaagcgaacgaccgagcgaggccacgcgaagcagtctgtccatatagccgggcaactgttcattgagcatatggaattcgtcgacgacaatcatgagtcgtgccggtgcatccggtagctgacgtatatcgctcacatgatggcgggcggcgagatgctcgcggcatgacagctcatcttccaaggcacgcaatgccctggaggcatatgacaggtcgaggtcgttgacgcatccacggacatggggaagtgcggccagccgatccagagcggaaccgcccttgaagtcaaggaacacgaatccgagtctgtcgggtgggtaggtgacggcgagcgccaggcaccagcattgcagcagcaccgatttgccggaacccgtggtgcctgccacaatggcatgcggcccttcgctgtcgatatccacgctgagcggcctcccgctggcatctacgccaagagtcgcccgcagccccgaggtatgagatgcgacgcaccatcgatgacagattgtgcgcatgggagcctcgtcatcgccgaatccgaagatcgtcatgaagtcccgatcacgcggtgtgggcatgcgggcaatacgattcatgttgtggtgatgaggctcgcatgcgccatccgattcgtatgatccgatcgggggagagtgatgcggagaatcgggggtgtatgtcagggtaaatgacgccagcatgccgaatatgcctgaagagaccatcagggcgaatagccattgacgttgcaacagcaacgccgtcagcacgatgatctgggcgagagcaggcatggctgcacgcaggaggtgtcccttgtgcctccaccgtttccggccgactgcggtgcgcaccgcccgatatggtgtttcaatgcccatgcgtccactatgcgccggttatcggggtgaatcaagcgcgacccgggtatgtggataactattgttgttcggaggttgagcccacctgacccggggcatggtcgccgtcatgcagctgcttgaaaagctcgaggttcttctggttgtccagcaagacgctggaacccacgccgtccacataatacccgggatctgtccagtacagacttccggtgatgccgttggatcctgaggcgtcgcggaaggcgagcagcatctgcagcatcgtccatggagtggatttgtcatccaccgtgagggagccaagtgcggcctcgcccactttcttcagtttcccgatgttgagcaatgtacttttcgctgtggccttctgtgcgatggcgccgatcacctggcgctggcggtcggaacggccgaagtcggagcgtggatccgagtatctcatacgggagaacgccaaggccgttctaccgtccaccacatggcaaccggatttccaatgcaactcggatttctcgtcatccacatcctggtcgtagcacaattcgacgccgcccagggcgtccaccaccttggtgaggccgccgaaggtgagcttggctacatggtcgatgtgctgaccagtgatcgattccacctgcgtcacgagttccttcttgccgaacacctgcatgacggcattgatcttgagcatttggtcgccgacctgcacgagggaatcgcggggcactgagatgagtgagcagggtccgtgcttcggcttggtcagtatgagaatcgtgtcggtacgctcacctggggtgtcatcggcaccggtggtgccgtcacgttcatcggaacccagaatgagccaggaggtaccgggagtgtcggagcctgtggtaagccacgcttccttgcgcagattggaattgacccagtcgtaggtgccgatgccgcctatgccgagcacgatgacgatgacaagcagcacaccaagtaccatgttgcgcacgcggtgtggtttcctggttgctgcggtcgccgtattacgcatggcggccggtgcggggaatcgtccatttcgagagttcgtaggcatctgatgcgagtgttggtgccgacttggtgagcggcgtggggcataggatggcgcggttgtgggggaaggctgtcggggggaatcggaaccaaccaccgaggatgacgatgatgagctgcgcggatttcggttgtgcttcggcttgaatgatgcgggcacggccgaggaggttctgccattatggggtgatgagatgtggcctggggtgaagctggggggcgttggcgaggaagcgttgggcgccgatgtgactggaggctgcgcggagcccttcttggaatgggaaggggcaaagctcggtgggagatcattgcctgtagcattgttgttcgtcatatgccctcgcctgctgattttccttgagaagcctatattgccaagatataccgatattatggaccaacgagatccggcggaatgcgaaggggccggccatcgggccgaccccttcgccgtttcagtcgtcgctgtgctccggcactttgcagatagtgttgttgaggtaacgataggagatgccgacgtattggttcgtgttcggatccttgatcgatccgtcgtccgggtccaccacgccaccggtctcagggtcggtcaagatgccatcgggatgcaccagcagcccggttttctcatcaagcctgggcttctcctcctgactcgacgaacccgagtcatcggacggctgtggtgaggggtcttcggtctgcgcgggctccgtcggctcctcggaaacggaaacttgggattgctcctcctcctgcttgtctgcgcccgcggagtcatctgaaccgaataacggcttggcttccttgaacttggcccacaccgccttggcatcctcggtccaaaccacgcggttggggtcctgaggggccgacatgatcggaacagtctgggaatacaggtggtcgaccttgagattgcgcagactcaaggccagacccatcaatgcattggtatcggccatgcccgagctgaagttgagtgaacggattgcattcatgaccagctggtacagctggctggtctgcgtgaacaggttccgagagatggccttctgcaacacggatttgatgaggtattgctgacgtgtcgtgcgcatgatgtcggagccgtcggtgtcgttgccgtggcgacggcgtgcataattggtcgcctccacgccattgagatggtgcatgcccttcttcagatgcatgttcgtgttcgggtcgtccacgtcggaggggaagcacaggtcgacgccgtcgattgaatcaatcatcttgctcagaccgttgaaatcgacgacgatgaagttgctgatatgaagtccggtcagcgcattcacggcgttgaccgtgcagctggcggcggaggagaggtcacctcccaccgaataggcattcgcgaagatcgagttgaactgcacgccgtattgggccggaatcgtctccttggaggtatggcatgccggcacgtcgacaagggagtctcgcggaatggagacgagattcacatagtttctgtcggccccgatctgcaccaccattgtggtgtcggcgttgtgtagccctccctcagtggccccgtcaccggagacgtcaccgttgccgtcgccatcgcgagtgtcctggccgatgagcacgaagttgattggcttgcctgaattgggatcgagataggcgtcttcgtctgactcaccctcgatgagacttctgattttgccgctctgcaccgcattgttgatgttgagccaggtggccgcggccacagagcccgcgaacacgagcacagcgaccagcaccatcgcgatgatcttgaggatccggtatcgcacgtgcctgacctgcacggtgctgtgccgcggatgctcgtcaacaggaccgccgatgttcacgatacgcttgctgtcgtcggtatgtgaagccaaagctcatacctttctgttcgtcgtctccgccggggagtgccggcgccgcccgcgcgctgcgtgcacacgtacatgtcgattcagtttcatgattataaggtactcgcttgagaaaaagatgggaatgggcgcatctgcacgcttttcaccccaagatgccttgaatagaccctgttgcgtacactggcgtatatgagactttccggcgacagcgagattcagcagctgatcagcgacaccttggcgcaacggccctattcccacgaccaaacggtgcgtgacgatgtggtggcggtgattacggtggagagcgacatgcgattcttcccggacacccttgccgccgtgctgagacagagcgtactgccgtcgaccattgtgattgcggattgctcagggcagaccctgcaatcggtgcagacgagtttcaaagtgatccccacgcaggctgatgcgctgcatggtgttcctcaggagcatacagtgcatgtgcaggtgctcaaggtggcgcaggcgcgttccttcggcgatgcggtggcgaaggtactgcgcaatgcgcagattgatacggcggcgaagaccttatggctgctgcacgacgattcacggcccgctgacccgatctgcctggaacagctgctcgacacgtggacgaatacgccgactgccgcgttgatcggctgcaaacaattggattgggatgccgtgcgtctgcacgatgtaggcaaatatgcatcacaccatgaggtggtgtcgttggtcgtggacggtgagcccgatcaggaacagtacgactcccgcagtgacatgttcgcggtctccctcgccggcgccctgattccggtgaacacatggcgcagtatgcatggcattaatgcatggttcaccacttacgacgaatcggcggatttctgccggcgcctatgtcgagcaggcaaacgcgtggtagtcgttccatcggcccgtatcgcgcatcgacgtgcaaggttcgaaggcattcgcacccatgacggtcagcccacctcagacggcaggatcatcgacacatcgatgccacagttgagtggcgagcagaaatacctgtacaccgatgtcacagccggctggtggcctctgctttgggtcggcagtgtgtttgcatgcctattccaagcgctcagactcctgtttcgcaaacagccttaccgtgcgtggtgcatgctgtgtatgccggtgctggcattgttgaatgtgccgcctgcattggtggcacgtcataggctcaaactggttcaggccatatcccgaagccagctgtcgaatctggtggcagacagggcccaactgaagatctggaatgcgcgcagcaaagcgtttgctgatgaacaggatggcgtggtgcttgatccattggcgcagtcccatctccatcgccgactcatacgtcgctggacgtacgcccttcttgcctccgtagtggcattcctctgtctcatggtgatgtattggccattgttcggtccggcattcgccggcgggtcactgtattccaatcagttgccggccactgatgccacattccggcagctggtggaggcagccaccaccacatggaatttcggtgccggtaccggtgtggctgcgcctcccgccccctggcttctggtgctcatggtggcgtcagtgttcaccggcggtcatgtggctgcggcggtgacgtcgatcttcttcctctccgctcctgcatgcgtcttgagtttctgggcactggcgggcgtggtgacgcgttccgatgagattcgtgtgttctgcggcctgctgtggttcgccacggcgttgtcgctgggcctgtattccagcgcgaaccttccgatgctgaccgtcatggtgttcctgccgggtgctttcgccctatgtttcaaagctgtgggcatgtaccgcaccgaacagccggtcaatccccgcgcttctgtgcaggctgccgctgccgccgcgctcatgttcattccggcggtggcggcggagccgcaattgctgctcgctctcatcgtcgtgttcgtggcttttctggtgttcgtgcgtcagcaccgtatgatgctggtgctcatccccttcccgtctgcattcgccatcgcccccactttggtgaatacggtgcgctatgcgggcaatggcatgatgcgccaattgttcggcgatgtcatggtccctgtcgagcaggtcaatggtgctccccgtctcatgaacctgagcgagttgacatggcgggctttcggcattgctcctcccacgcaatggggcacatggttcacgctgaatggcgcccgtgacgcggcgctgttcattgccgcatgccttatcactatgcttgccgtgatcgcattgctacgtccttcggtgttccgcgcaagtagaatcctgtggacagtctctctatgcggtctgctgctggcaatggtttctgcggcagtggtgattgccgcagagccatatggtccggcagccggctctgtgctgccaggtgttgcgatggcgttgtgtggcatcatcgccaatgttgctgtgttggcaggggcgggcacaaagcaattcactcgtcttgctgtggagcatgtttcaaatggtccggctcgcatcgcaggtcgtgtggcagtggcgttcgtattggccttgacatccttcgccggaatattttatggctaccagattgcctaccgtgacggcataggccaaagcgactatgcgctgccgcaggtcgcacaggagtatttgcgtgcagatgcaaaccggcgcattctggcgttggaggccacaggcgctgacacgatcgagtatgcggtgatgcgcacaggtagcggtgatctcatcgactcatcgcctgcgcagcgtgcccgcgaagccgtcgaaggtttcgctgatggtgcggatcaaaccaagatagcccgtgcaggagcccaattgctggcacagaacgacgatgatgcgatcgttcagctctcggatttggggtttggaggtatctatgtggtcaccgatggtcatgatgccagcggacgagccagtgcgcagttgctggcgaacatcacctcctgctctggagtgcagtccgtggtgagcaatgcaaaaggaacctattaccggttcaccttgaatccacccgctgaacagcacattgatgatgccggtattgtggagcagagccacaacccatggaggatcgcatggttgtggtgtctcggaatcatcgtgttcctgtattgcatcgtcgccattccacgcacccatgcgagcaacgaggaggaagcatgagcaagcacttcgagtccggttcatccaagcattcaaaggtgacgaaagtcgctgccaccacggtttccgcatgcgtggtggctggcgcactactggtcatggccttcatccccgggcggcagctgagtttcggcaacgccaatccggctaatgcctcggtggtgcaggaagtgagtccgaaggtcatggaccagtattgtccggcgcagatggggctggcggatacgggtacttacggagacagggaattccaagctagcgtgggggatctggcttcaagtgcacggtatgcggccttcggttcgattttccacgcacaggtttccccattgggcgacgattcgaaatccacggtgttgcagggaccacagtcggatgatgcggattccactgcggattcggtcgtggtggcgtcatccgattccgccgaagccccgcaggtgttcgagacgagactgctgggagcgagtgcaggaacaggggcgagtggatccatggcctcttgggcgagcaatggcgatatcgccggtgtggccgcctctacatgcatcaacacgcaattgaaccagagcttcctcatttcagggacgaaggagggcaccacccagcaactgctcatcgcgaatcctacagacaagtcgacgactgtgcagctttccatgacggggacggaacccgggcagattgtgatggccacgcaaagcagtgtcgtggttggcgccggcgaacagaggaccgtggatctggcagccgcggcacctaatcaggatgccctccgagtgaatctggtatcgcaggggtcgccggtggcgtcggtaatacgaacggtctcgatgaagggccttgatcctgatggcaatgatttcacgttgcccttgaatcctgcctccaccacacagattgtcaatatgggggattcccgcaatgcgatgacactgcgagcatatgtgtcccaagcggcttccctcaacctgtcgtggatcacgcaatccggtgtcaaaagcgcagggaagcgagccatgaaggcgaatgaggtgaacgtcgtcgaattgaaggacattcccgatgatgcattggccctgctcgtcgaaagtgatgtcgactttcaggccgcagccggcattgacgcatccgatgacggatcgcgtgatttcgccttcgtgaatgcggccagcccctatgcccaatctgcattggcgctgcccgcggaggtacaggcgcatgtgagcatggtcaacgcctcgtctaaatcgatcgagttgtcgctcacggcatacgatgaacatggcgagccggccggaacccgagatatccatttggagggagactccgcagtgatgctcagtccgacggacatctcgaagaatgccgttgcactctccacggattatcaggggagcgacctggtgtggggagcgttcctcaccaatgacaaggtcagctcatcagatcacgaaggtttggcctatgtcggcgccgagcggctcgaagtggccaaacagacggtgcgcgccatgcatgatgccaccatcatgcgctaggttctctcacatgccccattgcgggtcaatctcctctggtctgcggccatagagctcagctatacgcagcaccagttcatctcgaatggcgagctgaaggtccatccgcgatcgcgcatgactctgcaatggcatgcggtagagcactacacgggccggtatgccatgcgaagcgggaaacgcttgggaattgagcctcggattcgtctcccaaggggcgggggaggagggaggaacgtcctccacagcgaactgcaacggttctagcaattgtggccacgcatcgttgagacggcgaatctgggcgatcgccatgtcgtcgaacatgccactgcgtgtgcgatagcgcggtaggcggcgcccgaatgggggagtgcggacccctctgccgtgacgattccggtacgtcttctcttcccatggtgcacgaatcatggttccactgtagggcatcgcaccgtctttggtatattactctagtggaacagaacgcgaggagtaaggcgaacatgtcacaatcagtctcaatggccttggcgaacgaggtcgacatcgaacggctctgtgccacgatgaaggtgatggctttcgacctcgacggcacactcgcccgttcgaagaaaccaatgcacaagcccatggctgatgcattgtcgcagctgacgcgcctgctgcccgtggccatcatctccggtggcaccatcgacctcgtgcgctcgcaggtcaccgatatgctttccgatgaagccgaccgttcacatatgcacctgatgcccacatcaggtgcacgctactaccgttggaatcccgaggacgacgattggcaggaggcgtacgaacacaacctgagcgaagaggaccgcaggctggtcatcgaatcgttggaacgtcacgcccgtgaactcggcatatggcaggcgcgcacatgggggccgcgcatcgaagatcgcggtagccagatcacgttctccgcactcggacaacaggctccagtggaggccaaggaggaatgggaccccaccaatgagaagaagaaccggctcgccgaagccgtgcagaaggatgttccccatctcgcggtgcgttcgggaggttccaccagcgtcgacatttcgaacagaggggtcgacaaggcgtatgccgtacgcaagctcgcagacatgcttggcgtgacggtgggacagattgcctttgtgggtgatcgcatggaccccgatggtaatgactatccggcggctttggctggaacaatcgccatccgggtcaccggtccggaagacaccctgcagctttgcaaccgcatcatcgactggtataacaggaattcacgatagtctgcagacgcgaggagtgcggtatgggtacatcgttcgttcgggaatggtgtgcggcggccgcaggattgctcagggaactggggtatctgctgtttccacgcgggtgtgcgggatgtgatgctcccgatgaagtgctttgcagtcgatgcgagtcgaaattccaccattgcataccgttccgactgcatcccggtacgttgcatttgggatttgcctgtgcactctaccgtggcgtggcacgcgaggcgattctcaattggaaggaccacggcgatgaggaatgcgatggggcgttcgtcacggcattgaaccggctgttcgacgatctgctcgcattctgcagacaatcgggcgagcaattcccccaggcagctgttcccaacgacatattgatcgttcccgcaccatcctccgcctcctcattgcgtagacgaggccgcagccaactagcaccgctggcaaaggcgctatgctcacatgccaacgcacggggtatgcagacaacggtggcaccattgctcatcgtacgcgcccatagcaaatcagtcgagaccaacggtgccgatcaacgcgcgcagcgtgcgcgacggacgatctgcattaatgaacgtgccacccacgacaaggagatggatgcatgccgcacggtgatcctgatcgatgacatcgtgaccaccggcgcgacaatcaatcgatgtgccaccgtactcgccgaacatgggtatacggtgttcaccgcactcgcactggcctacacgccatcgaaacacggatacatggttgcctgatactcatatgaatatggcttctcgcctcgtgagcgggaagccatcgaaggggggtgcggaacctactgcttgcgaggccctgtaccctccacgtcgggatgcagcggcagtacgatctcgaaatcgacgcccctcgaatcgtccaccacatggatggagccaccatgcaacgtggcagcccatttcgcaatcgacagtccgagtccggtgccgccggattcactaccgcgtgtggtgatgcccatgacgaagcgctggaagatcttgtggcgcacatcttctggaatctgggaaccgaagttgacgatgtttgtcaccaccgtaccgcgcgaatcgtccacatgcgcctcgacgagcacactggcgtcgtcgagggaatgcttgagcgcgttggcgatgatgttcgtgtacagctgacgtaggcggtccacatcgccctccatcacgatgttcgagggaatgtgtgtctcgatgtcatgcccgcggctgctgtcaaggagcttcaagggggcgattgtctcgtcgatgaaatccgcgaagttgaactcctcgatgttgaggctcgaggaaccggcctcgatgcgcgataaatcaagcaggaaggagatcaggtcggtgagtcggtgtgtctgggcgagaatgctctccatattcttctcgttcggctccaccacaccgtctgccatattctccaccatcgcctgcagtgcggagacgggtgtgcgcagctcgtgcgccacattcgcgatcatgtcgcgccgcaactggtcctcatgctgcagttcctcggccatgtcgttgaaggcgcgggcaagctgtcccacttcatcgtacttattcgagaagtcgggaacacgcgccgtgtagtctccgtcggagagacgttcggcggcatcgcgcatctggcccaaaggatcggtcagatgccgcgacgtcgcgtaggtgaacaccagaatgacgatgagcgtgacgggcagcgccagccaatcgttgattttggtcttcgaaaacacccatgccagcaggaaggctcccacggtggcgaccacaatgagcatcgtgatctccaccttgagcgtggaacagtagcgaacgaggcgccgcttggcatccctacgatgctgcgagcgcctcattcggcggttgtatgcctcgtccgtcatgagccttacgcttctggcggttcgaaggcgtaccccacaccatgcacggtgcggatcgtggaggcgccgagtttatgacgcagcgctttcacatgggaatcgacggtgcgggtgctggaggcgtcaacccaatcccacacctcttcgagcagctgctcgcgtgtgagcacggaatgcggctgtttggcgagcgtggtcagcagatcgaactcggtgggagtcagatgcacttccttgccatcgagtgtcacctggcgcttggccggatcgatgaccaacgtgccgaaatcaaggatgcaatcattctcgctcttgtgcgcaatcaccttggcccggtccacgcggcgcagcaatgcgcgcacacgtgcgacaagctcacgcatcgagaacggtttgctcatatagtcgtcggccccgacacccagtccgatcaccacatctgcctcatcgtcgcgcgcagtgagcatgagcaccggaatgggatgttgtgcctcgatgcgtttcgttgcctcgatgccgtccatgacgggcagcatgagatccatgatgatgagatccggatgcaacttgtcggcggctttcaccgccgtggcgccgtctccggcgacacgggccgtccagccttcattggtcagtctctgggcgatggctgtagccagtgtgggctcatcctcgaccacgagtatggtgcgtcgtacttcgttgtcattcgaaggagcagacatgctattgctcccttccttcaacttgtgtcagttgttatccggttccaagaatacgacaccgagggccggcacggttatcttcgtagaataatcgcgcgaatggtaggggccggcgttggcttcgatattggtgttgtggatgtcggacccgccgtacttcctgtcgtcagtggtgagtacctcccgccaacggccgccttgtgggagcgccacctggtagtcctgccatgccgttccggagaagttgaccacgacgaccatctgctcgccgtttttgccgattcgcacgaagctcaacgtattgtggtccgaatcgtcactggtgagccactggaaaccgtcgggggtgaagtcctggctccacagggctggagacttcttgtacagagcgttgaggtcggccaccagttgctgcacgccacggtgatcaggccagttcaggcagtcccagtcaagctggctgttgtagtcccactcaccgtactgtgcgagttcattgcccatgaaggtgaggttcttgcccggatgtgcccattgataggcgaacagggaacgcacgccggcgtagcgctgccaatcgtcgcccggcatcttgccgaacagcgatcctttgccgtacaccacctcgtcatggctgatcggcagcacataatgctccgaataggcgtagaccatggagaacgtgatctcgttgtggtgccacttgcggttgatcggctgctcgtgcaggtattcaagcgtatcgtgcatccagcccatgttccatttgagtccataacccagaccgccctggtcggtcggggcggtgacgcccgggtaggcagtggattcctcggcgatcatcatgatgcccggattgttcttgtaggccgtggcgttggcctccttgatgaagtcgatggcctcgaggttctcgcgtcctccgaacttgttcggatgccattgaccgggttgacggctgtagtcgaggtagagcatcgaggagaccgcgtcgacgcgcaggccgtccatatggtactcatcaagccagaagcaggcgtcggccaccaggaagttgcgcacctcgcggcggccgaagttgaagatgtacgtcccccaatccggatgctcgccgcgggtcggatccgggtcctcatacaatggcgttccatcgaaacggcccaatgcgaaggcgtccttcgggaagtgcgccgggacccaatccatgattacaccgatacccgcctcgtgaagcttgtcgacgagatacttgaagtcgtcgggggagcccaggcgggagtccacgccataatagccggtcacctgatagccccagctgccgaggtacgggtattcctccaacggcatgaattccacgtgggtgaagcccagcttcgcgacgtacggcacgagcttgtcggcaagctcgcggtagctgtgtacgtcgtcacgccaactgttcgcatttacctcgtagatcgccacgggaccctggtgcgggtcggttttcgcgcgcttggccatccagtcggaatcgttccaatggtattcggactccaccacaatcgaggccgtcttcggtggcacctcgtgcgagcgttccattgggtcggccttcatctcccaagtgttgaatacgttgagaatctgatatttgtatttctcgccggccgtcacacccgggataaagatttcccagacgccggaggagccgagttcgcgcatcgaatggcagatgccgttccatccgttgaaatcgcccaccactcgcaccgaatgtgcattcggcgcccagacggtgaatgcagtgccgaccacaggttcgccatgggtgccatcattgccacccatggagtcctcatatcgcttgacgttggcgcccatggcctcccataggcgttcatggcgtccttcgccgaacaggtagagatccatctcacccacggtcggcaggtatcgatacgggtcgttctccaccaccgtggagccgtcctccttggtgatgcgcaggcggtagtcgggaaccgaataccccctgtcggttttcacggcgggaaccacggcgacatagacgccgttgagttccggttcggccttggtctcgctgtcgggggtgacgatgacgacttccttggcgtcagggcgaagtacgcggacggtggcggtgtcgctgtattcaccgctaccgaggtgggcgccgagaatctcgtgagggttgtagaaacgaccctcgctcacggtgccgagttgggcatgatccactgcaacgatggcatctttattgaaatgattgttactcatacatagaggataagcatgcaacacggggttcgggagccattctgcgtaaaaaagcgtcttttttgcccaaaacccttgcaagtccaagcgatagggcatacttatacgggtttttgcattgctcttacggaggattcatgggatacaaggtcggcgatatggtcgtatatccgcgtcacggtgcggctagggtcgaagagattttgcagcggaccgtcaagggcgtcacccgggagtacctgaagctctcggtgctctcatccgatgatcttgagatcttcgtgccggtcgacaacctgaagaaggtgggtgtgcgcgacatcgtggacggcgacgaggtgagccgcgtgttcgagattctgcgtacgccgatcgtcgagaaggagatgaactggtcacgccggtacaagctcaacgtggagaagatcgccacgggcgacgtgaacaacattgccgaagtggtgcgcgacctttctcagcgcgacgtggatgagcacgggctctccgcaggcgagaagcgcatgctcacaaaggcgcgtagcatactcacctcagagatcgccctgtcggaggaactcagcgaggaggagacgcagcgcctgctcgatgtgaacctcggttatgccgagccgcaggaaggcgatgccgagcatcacacggaggtccccgaggagccggcacaagacacgctggcccgtctcgagtccgagagcaagaagtcgaagaagaagtgagcgattcgtctgatctgcgcaatggtctgggattcgacgcgcatcggttcgccgatgcccgcaatcccagaccgttttttcttgcctgtttggagtgggaaggcaatggtgtcgagggtgattcggatggcgatgtcgccgtgcatgccctcatcgatgcattgtcgtcggccaccggattgggcgatataggcacgctgttcggtgtgggtgcggattcccgaggagccgggatgcgcggtgaagcgatgctccgtgaaaccctcaggttagtgcatgcccatgggttcgagccggtgagcatgtcgatcagcatcatcggcaatcaacccaagatcggttgccgccgtgatgaggcacagcaacgcatgtcacagatctgcggttgcccggtcggcatcacggcgaccaccaccgatggcatgggcttcaccggcagaggcgaggggttggccgccatcgccagcgtactggtgaggaaaacggtcgcgtctgcgtgagcagtccccgtccatcagaggcatatgtgcgagtgcgccgtgacaatctatgaggattgtcacggcgcactcaatgcgtcagccgaatctgggtcgtcgccccaatctcgtcagtcgccattccggtggttcctgacactttcgacgcccttcgcaatgccccagaacagtgtggacaacgtgacgatcacgaaactcggaggggcggggaacatcgtggagatcaccagcccaccccagatgctcaccagacacagcaccatggccatcacaatggctttgaacggcgagtcggtaatgatcatggacgtggctgccggtgtgaccacgagcgcgaagatgagcagcgttcccaccgccggcaccgcgatggtgatcaccccggccaggatggtcatgaacagtgcattcatgatgccaacccgaacacctttcgcctgcgccacctgctcatcgagcgagctgaacagcaacggccgatagacgatgcacatgaggatgatcagcacggcgtcgaaaatggcgaaaccgataatctggtccggtgtgatcgtgaggattgacccgaacagaatggcctgcagctgctgggatgcagagcttgacattctggcgaagtacaggccgaggccggtggcgaacgcgagcacggtacccgtggcgatctcgcgttccccggcccgtttgcccaaagccgcaatcacccatgcgccccccacggcaaacacgcccagaccgagggcgatgggaacgcccagcagcgccgcgccggttgctccgggcaatgcgatgtgcgcaagcgcatgcgaggcgaaggtggagttgcgcgcaatggtgaagtagccgatgatgccggcactcagcgcgatgcacagacctgcgaggaaggcattgcgcatgaagggcatcgtaagcgtctgcgtccatagcgggtcataggagaagaacgagctcattgtccattgcctttcctgtcgatgtgcgcgtggtcgtcgtccatgcgcacatcctcatggtgatggaattgtgcgacgtcagacgaggagtgcatgtctgggtgatcgttgcatccgatgttgtctgcgttcggggtgacgaacatgtctccctgcggggtggtgaccacctgcacttgggtgccgtagaggtgtgtgagcaacttggagtcgagcacctcgttcagcttggcgaagtgggggtgcccgtcgagcaggtatacggcgccggtgagaatcggcagcagcatattgaggtcgtgcgccaccacctggatggtcatgccgagttccctgttgagcttggccagaatgtgcacggtggagcgttggctggccagatcgagattggccaatggctcgtcgagcatgagcagctctgggtccgacaccaaggcctgggctatggcgacgcgttggcgcaggccgcctgaaagctgggagagacggtatggggccttgtcgagcacgcctacgaattccatcgcctcacgtgccttgtcccgctcctttttcgaaatgatgtggaagccgaaacgggtgcctgtcagaccgagcaacaccgattgctcggcggtcagcgatgagtcgatgtcggaggcgtagctttgtggtacataaccgatgtgcgcattcatctcaccagccggtttgcccagcacggtcatcgtgccgtgggaaagcggtatgagcccgagctccgctttcatcagtgtggttttgcccgcaccattcgtgccgactatggcggtcgcgctgccgcgtggaatggtgaaggtgccttcgctccaaattgttcgccctccgcgtgagatcgcgatgtcgtggcatacgatgcagggctgcatcggtgtcatccgatcggccattcgctcacctcttcttcttggattcgtatgcgactgccaacggcgtgcgcatatccgacgaattcagtgttccaatcagtattgacaatcattctcaataagagggcagctgattgatggagacaggtgcatggtattgcctacttcgtggcaggagtctcctgctgtgtgccgacgctcggagagggtgatgatgcggcctcgtgttcctgttcctgagagactttggagatgatcgattcgctcagagtgtcgatccaagaggtgaggtctttgcaatccttgggcatctgctcggtgatgtcgatcaccgggatgctcgccttgtgcgcggcctgggtgagcgtggcgtcggtttgcgcactttgctgtgggttgttaatcagcagattggtttgcctgccttgcagcaagtcgctgaacgccttgatatccttctcgtcgggctcggtgccgtcgagcatggccttggcatagcccttcggcgtgacgtccctgaatcccaagtcgctcatcagataatacgcgacatcttccgtggcggcataggtgggatctttgagcgacttgctgcgttccctcatctgtgattcaagctcgtcctcgtcgctctgccatgttttcagattgctttcgaagtatgccttgtgctcagggaggagcctgctgaacacctctgtcaattccctggccacggcctgtcgggcgtcacgtgagaaccacaggtgtgggttgtcgccatccaatgcacccactgtgtcggccacggacacccgtgtcacgttccggggaagtgaacggtcggcccaagtgtcgtatcctgcgccgttggtcagcagcacttgggccttgcgcatctgggtaacctgtttggcattcggctcgaaagaatgtgcgttggtggtgtcgggggggaggatcgacgagacttccacctgattgccgccaatctgcttcgccaatgacccccattggttcagtgtggcgacgacggtgattttcgaggcgggggtagtggagccgtttggcgttggctcgttcgtctgccgggaaccgaaccagctgcaggcgctggtgcccagaatcagtgcgatgccagccaagatggcggcgatggcgtggagtccgttgccgagtgtacgcatgacgttccttaatatgggtgcttgatgtcgattcctcgtttcttctgcaataataggtcgggacatggccgaggaaagactccaccgaatgcgaaagggacattcatatggcaatcgtattagacggaaagaaggtggccggccagatcaaagccgacctcgcctcgcgtgtggccgggttggcgaggatgggtatggtgcctggtctgggcactgtgctggtcggtgacgatccgggttccatgaagtatgtggagggcaagcacagggattgcgaggaggtgggaatcgcctcgatacgcaggcagcttccggcgaccgcgacgacggaagacgtgcttgccgtcgtgcgcgatctcaatgaggatccggcatgcaccggttacatcatccagctgcctttgcctgcccacatcgattcgaacgccatcatcggcgccatcgatccgaccaaggacgccgatggtatgcacccctacaatctcggggaactggtgcttcatgttcgaggtgacatcaccacgccgttgccctgcaccccccgcggggtgctcgccctcctcgacgcctacggcatagaactggcgggcaggaacgtatgcgtgctcgggcgcggcataaccatcggtcgcaccattggcctgatgctcacgaggagcggtgtcaatgccacggtgacgctctgtcacacgggcacccgcaacatcgaggagcacattcgccgcgcggacgttgtcattgccgcggttggtgtcgcagggttcgtccaggtggagcacgtcaagccgggggcggtgctcatcgatgtcggtgtatcgcgggtattcgatgaacaggccggcagaatgcgcatagtcggagacgtcgattccgaggctcatgccgttgccggcgcgtattccccgaatccgggaggggtggggcccatgacgcgtgccatgctgctcgccaacgttgtggaacaggctgagcgcatggccggtattcgtgaagattcgtgagccattcgctcggggaacgcgacacgccggcggaaaagcgcgttttggctagtgcttcgcctataattgagtctgcatgtgtttggggcttggtgtatccagccgtcgagcatatgcctgaataactgaatatcgatattatccacccaactattcgaagaaaccacattaatggcagaaaacaaagcagaagtcgaaaaggtcgccatcaacgacatcggcaccgttgacgacttcatcaaggcagtcgattccaccatcaagaacttcgacgatggtgatctggtagagggcaccgtcgtcaaggtcgatcacgacgaggttctcctggacatcggctacaagaccgaaggtgtaattccttcccgcgaactttccatcaagaaggacgtcgatccggatgatgtcgtcaaggtcggcgacaccatcgaagcccttgtcgtcacgaaggaagacaaggaagggcgtctcatcctgtccaagaagcgcgcccagtacgagcgcgcctggggcgacatcgagaagatcaaggaaaacgacggcgtcgtcgagggcaccgtcatcgaggccgtcaagggcggcctgatcgtcgacatcggcctgcgcggcttccttccggcctcccttgtcgagatgcgccgcgtgcgcgatctctcgccgtacatcggccagaagatcaaggccaaggtgctcgagctcgacaagaaccgcaacaatgtggttctgtcccgtcgtcagtacctcgaggagacccagtccgaggttcgcgagaccttcctctcgcagctcaagaagggccagattcgcgaaggcgtcgtctcgtccatcgtcaacttcggcgcattcgtcgatcttggcggcgtcgacggcctcatccacgtctccgagctctcctggaagcacattgaccacccgtccgaggtcgtcaaggtcggcgacaaggtcaccgtcgaggtgctcgacgtcgatctggaccgcgagcgcatctcgctgtcgctcaaggcaactcaggaggatccgtggcagcgcttcgcacgcacccacgttccgggtcagatcgtgcgtggcaaggtcacgaagattgtccagttcggtgtgttcatctccgtcgaggacggcatcgagggcctggtgcacatctccgagctcgccaaccgtcacgtcgaaaatccggagaccgttgtcaagccgggcgaagaggtcttcgtcaaggtgatcgacgtcgatctggaccgtcgtcgcatctccctgtcgctcaagcaggccaacgactctgtcgacccgaactccgaggatttcgatccggcgctctacggcatgccggccgagtacgacgaggatggcaactacaagtacccggagggcttcgacccgaacaccaacgagtggattccgggctacgagaagcagcgtgaggaatgggaggcccagtacgcctctgctcacggtctgtgggagctgcacaaggaattcgtgcgcaaggagctcgagaacgccgaggcctccgctcaggaggacggtcaggctcctgccaaggaagagaaggtcgaagagacttcgaactactcctccgagtccgaatccaacggcaccctcgccgattccgaccagctggccgctcttcgcgagcagctgctgagcgagaagaagtgagccgctgaagctgttccgcttcgattcgggaggcgtcatgtgcacacgcgcatggcgcctccctccgtatatgcccggtacatatcccatgcatgtgaaaaggaggcatcatgcagaccgtcaacgggtggcgatgcatgcgcatcgcgctgaccggtggcatagcagcgggcaaaagcactgtggccaccagaatggccgaagacggcgccgatgtgatcgactatgaccatcttgcgcacatcctgcaggagccatgttccccggcgatcgatcctctggtcaaggcattcggccctggcattctgaacgggcgcggaggcgtcgaccgacggatcctgtcccggcatgtgttcggagaaggggccccggataacgccaccgaaacactcaacggcatcatgcatccactggtgtacgagctcgctcgcaatagggagcgaagtttggtcggcgacggccgcaagcatgtcatcgtccacgatatcccgttactcggcgaggtcatggacacgattccattcgtgttcgacgccatagcgtgcgtcatggcaccggaggatctgcgtgtccgcaggcttgtcgagacgcggggcatgaccgaggagcaggcgcacatccgcgtgtatgtacagggagacgaggcctcccggctgcggtatgccgacgttgtcatcgacgcgacacagccgatagaacagacgttcgaatatgttgatagccttgtcggacaatggttcgccgaggagtaaggatcgccatgggattcaacatcgagcgcacgaacaagccgtttgttgtcaagtcgccgtaccagccctccggagaccagccgaaggccatagaggaactggccactcgcatcgagaacggcgagaacgacgtagtattgatgggcgccaccggcaccggcaagaccgccaccaccgcgtggctcatcgaacggctgcagcggcccacgctcatcatcgaaccgaacaagacgctcgccgcccaactgtgcgccgaattccgcgagctgatgccggacaacgcggtgagctacttcgtctcgtactatgactactaccagcccgaggcctacatcccgcagaccgacacatacatcgagaaggattcgaacatcaacgacgacgtggagcgcctgcgccatgccgcgaccgcgaatctgctcacacgtcgcgactgcgtggttgtggccaccgtctcctgcatatacggtttgggcacgcctgaggaatacgccggtcgcatgctctttctacacgagggagaccagattgatcgcgacgatctgctgcgcaccttcgtcgacatgcagtacaagcgcaacgacatcgcattcacgcgcggcaccttccgcgtgcggggcgacacggtggagatcatcccggtgtatgaggagctggccatacgcatcgagttcttcggcgacgagatcgaccgcatctccacactgcacccgctcaccggcgacgtgatcgagcaggtcagtgacgtgcacatcttcccggcttcgcactacgttgccggtcccgaacgcatggcgaaggcgttggattcgatccagcgggaactcgacgagcgtgtggccgagctgcgcaagcagggcaaggagcttgaggcgcaacgtctgagcatgcgtacgacgtacgatctggagatgctctcgcaagtgggggtgtgctcaggtgtggagaactattcacgtcacttcgatgggcgtgcggccggcacgccaccgcacacattgctcgacttcttccccgacgatttcctgctggtcatcgacgaatcacacgtgaccgtcccccagatcggcgctatgtacgagggcgacgccagccgcaaacgcacgctggtggagcatgggttccgacttccctcggcaatggacaaccgtccgctcaaatggccggaattcctcgatcgggtgggccagaccgtctatctgtcggcaacaccgggagattacgagctggggctttcggatggcgtggtcgaacagatcatacgacccacaggcttgctcgatcccaagatcgaagtgcgcccggtggagggacagatcgacgatctgctcgccgaaatcaaagatcgtgtggccgcgggggagcgcacgctcgtcacgacgatgacgaagaagatggccgaggatctcaccgattacctgctggaacgcggcatcaaggtggaatacctacactccgacgtcgacacgctgcgacgcgttgaactgctgcgcgaactgcgtgagggcaagatcgacgtcatcgtgggcatcaatctgctgcgtgaaggcctggatctgccggaggtgtcgctcgtggcgatcctcgacgccgacaaggaaggcttcctgcgctcgtaccgatcgctcatccagaccattggacgtgctgcacgcaatgtgagcggtacggtgatcatgtatgccgatgagatgacggattcgatgagcaaggcgatcgaggagaccaatcgtcgtcgtgagatccagatggcatacaacgaggagcatcacatcgaccccaagccgctcatcaagaagatcagcgacgtcaacgacatgctcgccaaggaggacgtggacacgcaggaactgctcgagggcggctaccgcaactccggcaaggcaggtaactcgcatcttggattgccgaacacgacgcccgaggaagccgacaggcgccatgaggagattctcaaggccggccttcccgcacaggatctcgcagaccttattcgccagctttccgatcagatgcataccgcggccgaacagctgcaattcgaactggcggcgcgcttgcgtgacgagattcgcgacctcaagaaggagctgcgggccatgacacaggcgcagcagtagacagcccatttcggacggcttgcgttaagctggcctgtatggcagaaacacctatctcgttcatgatcggcacctatgtcgtgctggtcgtcttcttcgtcgtggatctcttcgtcctggggcgcaggcctcatgtaccgtcgaccaaggaatgcgtgcagcacattgcgttcttcgtcgccatggcgctcgtcttcggcggattgatatggtgggtggccggggccaagccggccgttgagttctattcgggctggctcaccgagtattcactcagcatcgacaacctcttcgtgttcgtcatcatcatgtcgaacttcgcggtgccgaagaaactgcagaagttcgttctctcggttggcataacgattgcattggtgcttcgcgggctgtttattctcatcggtgccgctctggtctcgcgtttcacctgggtgttcttcattttcggcgccttcctcatctatacggccgtcaaagtggcgataggggaggacgacgatgaggagttccatgagaacggactgattcgcctcatgcggcgattctcccatatcacgaatgaatacgacggcgagaggctgcgcaccaccatcgacggcaggaagtattggacccccatgctcatcgtgttcatcacgatcggcaccaccgacgtcatgttcgctttcgactcgattccggcgatattcggtctcaccaaggatccgttcatcgtgttcacctccaatgtgttcgcattgctcggccttcagcagctgtacttcctgctgggccgcctgctcgacaagctcgtgtatctgccggtcggcctgtcgcttgtcctcgggttcattggtgtcaaactcattctcgaggcgttgcacggcaacacgcttccgttcatcaaccatggccaaccgttgggcatggtgccggaagtgcccacgtggctttcgctggttgtcatcatcgtctgcattggcggttcggcattagccagtgtcatcaagatgaagtcgatcgacgcgaagcaggccgcggcaccttcggattcgcaggagcgcccctgaggcgacatgccggagagccatatggtgtgtacttgcggcacaatggttgtgagcgctcacagacttcttcgctatttgcgacaggctaaagcgaaaaaggagtaagctagagcaatgttgaatgtgctctccaaggagcacaaccgtcaaagaataggtaggcattcatgcgtaaagcaaagatcgtagataccatcggtccagctactgaatctctcgaaaacctcaccgcgctcgtcgaagcggggatggacgtggcccgtctcaaccgctcgcacggcactccggaagaccatctgcgcgtgtacaacaacgtgcgcgaagcatccaagaccaccggccgcaacgtggcggtcctcgtcgatctgcagggtcccaagatccgctgcggctggttcaagaagaacgccgaaggcgaagacaaggtgcagctcaaggaaggccaggagttcatcatcacgaccgatgacgtcgaaggcgatgaacacatcacctccacgacgttcaagggcctgccgggcgattgccatccgggggacccgatcctcatcgacgatggcaaggtccgtctcgaggtgaccaaggtcgaaggaaacaacgtgcacaccaaggtcgttgtcgccggcccggtctcgagccacaagggcatcaacctcccgggtgtcgcggtgtcgctgcctgcgctgaccgagaaggatgagaacgacctgcgttgggccatccagaccggcgctgacatcatcgccatgtcgttcgtgcgtttcgcgaccgacatcgaccgcgcccatgagatcatggacgaagaagggcgccgcatcccgatcgtggccaagatcgaaaagccgcaggccgtggagaacctcgaggatatcgtcaaagtgttcgacggcatcatggtcgcccgtggtgacatggctgtggaaatgccgttcgaagaggtgccgctggtcaccaagcgctgcatcgagctgtcccgccagtacgccaagccggtcatcgtggcgaccgaggttctcggctccatggtgcattcgccggttccgtcgcgtgcagaggcctccgattgcgccaatgccgtgcttgacggcgccgatgcgacgatgacctccaacgagaccgccgtcggcgagtatccggtcgagaccgtcaagacgatggcccgcatctccggctatgccaccgagcacggcttcgatcgcatccctcacctcaaggatctcgacatgtcgagcaccggcgcagtgtcgtccgcagccgctgatctggcagagaagctcaatgccaaggccatcgtcgcctacacgcagaccggttccaccgtgcaccgcgtctcccgtgagcgcccggccaccccgatctacggcctgacgaccaacgagcacacctaccactggctcgcgctgagctggggcaccgagggcatcaagctcgatgaggattaccacgacatgtcccgcaaggatctgatgaccttcaccgacgaggtgctgcgcaagaacggcaaggtcgccaatggcgacaagatcgttgtgctgagctccgcccagggtgagcatctgcccggccgcaccgattcgatctacgttcacaccgtgggtgcctgcgactgatcgcatatacccgtcagcgtcctaagcgcatgacgggcaggacgctcatggggtgtgcatccgcggatgcacaccccatgttgtcatctcggagtgtctgaattggcaaaagccgaggtatgtgctatattcacataggttgctttcgcccctgtatcccaattggtagaggagacagcctcaaaatctgtacagtgtgggttcgagtcccaccgggggcaccgacaggctcgccgtgaacattcatggcgagcctttttcatcgcatgttatccgctgttaacggaacatcgcggttcgtgctgtatacaatgggaaacagacagatgagccgcagacaaccagaaaggactggcatgagcaagcaaacctatcgtcgcttcgatccatggcgcagtacccccatccaagaggaggcgcgcgaaaccatagtcggcggccactacttcaacatcgaccgcgtatcgttaacctccccgacggtggggcatttcgaacgtctcatcctgcacaagaacaacggcgattcagttggcgtgataggactgacgaaagacggcagggtcccgctcatcgaacagtaccgcataccagtgcaccgttggacattggagattcccgcagggcatgcggtcgacaagggcgaaaggccgatcgacgtggcgcatcgcaagcttgcggaggaagtcgggtacaaggcgggggtgatgacgcagttctgccgcttcatcaatacgccgagctactccacgcagcacaccgccctctacttcgcatatgatctcgaaccgatcgacgaacgggaacagtacgccaacgaggcacgtgcccaggttcgcttcctcaccccgcaggagtgctatgagctggtgctcaacggcacgattctcgatgccaagtccatcatcgccatccagcgcctgtacatggcgccgaaccatatgatcggtgtttccccgtacgatggggctccggcacgagactgacacgcatgttagcgcataagtgcgctacactgtgctgttggagcactgaatacgtccgacaggaatatgtcatagcccgcatgtgtatgcgtatatggagcgcgggcatgaaataatgaatggagagcttgtatgtccaacgaagagcaagagagcatcaccgaggaaccaacggttgacaacgccgccgatgcgatcgaggtggctgacgcacaggtcgccaagaaggaggccaagcgcaatcccaccgtggtcgtggccgaagacgagtcggtgaaccgcatggatctggtggccatgctcgaagacaacggatatgaggtggtgggtgaggctgccaatggtgaggaggccatcgaactcacgcgcgagaagaggccagatgtcgtgtgcatggatgtcaagatgccgcatatggatggaatcaccgcggcgggcgtgatctgcgatgagaatctggcccctgtggtcatgctcacggcattctctcaggccgatctggtgaaggaggccattggtgccggagccatggcctatgtgaccaagccctatgaggaatccaagctgctgcctgccttggcggtggccatgggccgtttcgccgagatcaacgatctgcttgacagcgtggaacgcaacgaaagcgaattgcgcaccacccaggagcagttgagggacgccgaggaggaactgcgcaagaccaaggagacgctcgaggaacgtaagctcatagaccgtgccaaggggttgctcatggataaagcgaacttctcggaatccggggcgttccgttggatccagaagacctcgatggaccagcgcattccgaagaaacgccttgcacaggccatcatcgagaaatacagcgacaagccgaacgatggggagtgacctatggcgctcaacgtgacgtgcaaggcattgcacgtcacgttttcatatggtgacaaatcaacggaacgggtgggtaatggaaacgaatgaacagggcaccaggggaacgttgctggtgattgatggccattcgctggcattccgtgcgttctacgcactgccagcggagaatttctcggccaaagacggtcaggccaccaatgcggtctacggcttcttcacgatgctttcgcaggtcatcgcatcgcagaagcccgatctgctcggcgtggccttcgacgtgaaggggggcaccttccgcaacaagatgctcacccagtacaaaggcacacgtgaagcagcccccgaagaactcatctcgcagattccgctcatccaggacatgcttgaggcgttcggtgtgacctatgtgaccaagcagggatacgagggcgacgatgtgatcgccacactggccacgatgggggagcatgcggattaccgcacctatgtgctgtccggagatcgtgatgcattccagctcatcgatgacgacatcacggtgctgtacccgggctatcatttcaaggaactcaaggccatgaccccgcaggccgtggaggacaaataccatgtcaccccgcgccaataccccgatctggccgcattgcgcggtgagaccgccgataacataccgggtgtgccgggtgtgggtgacggtttcgccgccaagtggatcaaccaatacggtggtttggacggtgtgatcgagcatgccgacgagatcaagggcaagaaaggcgacgcactgcgtgagagcattgaacagatcaggctcaatcgcaaggtgaacgccttggtgcgtgatctggatctaggtgttgacatcgccgacctcaccttcggcaaagtggatcccgccaaggcggaggagctgttcaaccagctcaacttcggcgcacgcattcgaagcaaactcctcaaaacattcaatgcgggggacccgggccagccggtcgcgaaaaaggcctctgacgctgaacggttcgagttcgaaggggagtttgacgatgggtcgttcgacacccccgaatcagtgagggtgcaggaacctgtggtggatgaaatcgacgcccccgcgtcgcttgaggcatgggcccagcaacactgtcccatcgcctcgggcaagagcatctcgtcaaccacattggatgtggtgggcgaatatgacgcgcaaagccagcaatgcgtcgaagccgtggaaggttcctggagtctgttcgcatcgggaagccccaagccgggacgatcctcgatctcgggactggcgttgatggccgacggtcatgcggtggtggtcgacccgcatgacgagcagtaccatatggctctgcagcgtattcttgacacctatgccgccacactgagcgtccatgggtacaaggagcatctgcacatgcttggtgccgtgaatctgcgattgccgatggtgctgttcgacaccaatcttgccggatatctcatagacccggatttccaagggggatcgctgcaggattgtgccgatcacttcctgcatcggcacgccgaggaggtgacggagacggaacagggcaccctcgatatcggaatggatgacgaacgcgccgaacgtgaccgaaaggtggtgcgtaatgctgccattgtgagcctgctggcccgaacgttggctcggcagcttgaacaacgctgccagtacagcctgttgcgtgatatcgaattgcccacctcggtggcgttgttccatatggagcacaccggagccagcgtggaccgtgcccgtctcgatgaattgctggagatgttcaccgacgaatccaaccgcatggaacagatctgttatgaggctgccggccatgaggtgaatctgcaaagtcccaagcaactcggtgtggtgctgttcgaagagatggggctcaatcccaccaagaagacgaaaagaggctcatactcaaccaatgccaaggcgctcaccaccttgtacgcgacctccgaggaggggagccgccccaacgagttcctcggagcattgctgcggcatcgtgaggtgaacaagctgcgtcagatcgtgcagacgctcatcgacgccatcaatccgcgcgatgggcgtattcatacgacgttcacgcagacggtcgccgcaacgggacgtctgagttccgtggatccgaatctgcagaacattccgaaccgcaatgccaccggccgtgacatccgctcagccttcgtacctggtgaggggttcgcagacctgctcagcgccgactattcgcaggtggagctgcgcatcatggcggatctgtcgggcgacgaggcgctcatcaaggcattcaagtcaggggcggacttccaccggtatgtggccagtatggtgtacggcatcccggtcgacgaggtgacgcccgaccaacgcaaccacgtgaaggcaatgagctatgggctggcctacgggttgagcacctatgggctctcgcagcagctgggcatcccgtcgaaggaggcggctgcactgcgatcgcggtatttccagaccttcggcaaagtgcatgattatctggagtcgctggtatccaatgcccgcaataccggctatacgcaaacgatgtttggtcgacggcgttatttccccgccttgacatcggccaaccgggtggcacgagatgccgcggaacggggtgcactgaacgccccgattcagggcactgccgcagacatcatgaagatcgcgatgatccgcgtggatcgcgctttgcgggacggcaacctgaacagccgcatcgtgctgcagatccacgatgaactcgtggtggaactggctcccggcgaggagaagcgtgtgaccgagttggtgcgtgatgcgatggagcatgcggtcaacatcgccgtgccgcttgatgtgtccaccggtgtggggtccgattggcagcaggccgcccactgagcaagttctgggcggcgtgggataaggagtgaatatggccacggtatacgatgtgatgggtgcgctggaaacgctgtacccattgcgatatgcggaggattgggaccatcctggactcattgtgggtgatctgcgcaatacggtgaacaacatcgtgttcgcggctgatccgaccatggaagtggtcgaagacgccatcgcgagtggagccgacatgctggtgacgcaccacccgctgttcttccgcgccgtgcacgaggtttcaggccgcacattccgcgggcgcatagtcaacctgcttgccaagcacgactgcgcgctgtgggtaggacacacgaatgccgatgccgcctaccgtggcgttgcgcaagcagccgctgatgcgttcgggcttgagaatcaggcgccgatagtgccgattgacgatccgacttcctcccatacggtgggcattggccgtttcggcaggctcggtacgccgacgacattggagcgtttcgccacccttgtggctcaggtgttgccattcacgaaatacggcatacaggtggctggtccgctcgacatgccgattcgcacggtggcggtgcttcctggttccggcgattccatgttcgcgaatgtgcatgcattgcacgccgatgtgtatgtgaccagcgacctacgccaccaccctgccaccgatgagcttcaggaatcgtactacgaagcctccatgcgcagggaggggatcggattgggagggccgtccgattgcccccacatgcgccccgcactcatcaacaccccgcacagcgccatagagagcatgtggttcaactatgcgctcgaagacgttccgcggatggtgcaggaagttacgggagacattatcgacgtgcgttggaacacgacgagcaccgacccatgggatctggtccttccgggcgtctgcggccatcccgatccatcgccagaagccggtaggtgacccatgggctgcgacagtgagcggaatgtggaatctgagatcatcgatgccatgctcgaccgcagttcagatggcgtgaacatggacatccccgcgcgagtactggacagtgagaccaagtacaggggtgctatattccatgtcgatgatcgtagaatcgcattgacgcggaacaacggcgaccagattgtcatccgccggcaggtgctggtgcatgcgccctgtgtggtcatgctcgtgcatgattgcgtgcgcgacacctacctgattgaacgagagtaccgtgcggggattggacggttcacctacgggctccccgctgggctgatcgaccatgacgaggacccgcataccgccgcgttgcgtgagctacgcgaggagacgggtgtggttgcggacaccgacggtgacgtgcatttcgatatcgtcggcgattactactcctcggagggcatgaccgatgagcttgcgcatatcttcgtgctccatctgcatgcctggcatgccacacacaccgagttcgatggtgacgagcatgttgagtcgacgtgggtcggttgggacgatctgctcacgttgccggttaccgcatcgaactcgatcatcgcgattcagcatgaacggatacgccgattacgtgaattgcaggttaaatagccgagaagcaaaatcgcacgtgccaccgtggaatgtgccatactgggatacatgcaagcacgaccaggttcaatgtatccgttaggagccagctacgatggcgccggcgtcaacttcgcgctcttctcccaagtggccgaacgggtggaactctgcctgttcgatgatcaggacaacgaaagccgcatcgaactcaccgaacagaattcgtatgtctggcatacgtatctgcccggaatccagccagggcaacgctatggctatcgcatccacgggccgtacaatccggagcaggggcagtggtgcaacccgaacaagctgttgctcgacccgtacgcgaaggccatagaaggcaacatcgacggtgacgaaagtctgttctcatattggttcaacgacccgaacaaccccgacaacatgaacgatctcgattccgcggcgcatatgatgaaggccgccgtgatcaacccgttcttcgattggggcagtgaccagcacccgtacatcccatattcggattgcgtgatctacgaagcccatgtgcgtggcatgaccaatctgaacaaacaggtgcctccggagatccgaggcacctatgcaggcctcgcacacccaaacgtcatcgaatacctgaaaaaactcagggtgaacgcgatagagctcatgccgatacaccagttcgtcaatgacccgttccttcaggagaaaggcctgaacaactactggggatacaacaccataggattcttcgcgccgcataatgcctacgcaagccaaggccagcgcggcgaacaggtgaacgaattccgcgccatggtcaaggagtttcaccgcaacggcatcgaggtaatcctcgatgtggtgtacaaccacactgcggagggcaaccacatggggccaacgctcagcttcaagggcattgacaatcaggcgtattaccgtttggtcgacaacgacccgttgcactacttcgacaccaccggcactggcaactcgctgctgatgcgctcgcctcacgctttgcaggtcatcaccgattccttgcgctactgggtggaggagatgcatgtcgacggcttccgcttcgatttggctgcgaccctcgcacgccagttccaggaggtcgacaagctctccgcattcttcgacatcgtacagcaggatccggtgatctcacgggtcaaactcatcgcggaaccatgggatctgggttccggtggatatcaggtgggtggattccccccgaattggtcggaatggaacggtcatttccgtgactgtgtgcgcgatttctggcgctcgcagccatccacgctgcccgagctcgccagtcgtctcatgggttcctccgatctttatcagaagaacggccgaaagcccgtcgcctcgatcaacttcgtcacggcgcacgatggtttcaccatgaacgatctcgtcagctataacgagaagcacaacgaagccaacgatgagggcaatcgtgacggcgagaacaacaaccgttcctggaactgtggtgtggaaggacccaccaccattcgcgacgtgaacgaattgaggcatcgccagatgcgcaacatgttcgccacgttgctgctttcgcaaggcatacccatgatctgcggcggcgacgaggtgtgccgcacgcagttgggcaacaacaatgcgtactgccaggacaacgaattgtcttggacccattgggacctcaaagactaccagcaggacatgctggacttcgtcacgaagctcatccatatacgactcgagcatcctgtgctgcatcgccggcgcttcttcaccgggcgcagcagcgatatgccgcaggatgcagtgcctcaggtggaatggttcgagcataatggcaagataatggatgccgaggcttggtcgaatacgcatgcctcgtccatcatggtgttcctcaacggcggcggaatgccggagacggattggtacggcaaccgcatggtggacaatgatttcattctgattttcaatgcccattacgagccgatcatgttcacgttgccaagcgagcagtatgggcgcaaatggcggctcatcgtcgacacacacaatccaaagggacccgagctcaattacgaggcgggattcgccatcacggcccagtcaagatcgttcctcatgctcatgagcgaccgtaaagcggatcataaccagcgttgagatatgttgcgtatgcgagcgaaaaaccattcgcatacgcaacacgcgtcgatataaggtcattatgaccgttgggccggtacacccttcgaatcgttgcccacaatgccgggatcctcgtcaagcacggtctggaattccgtctccgcggcgtcatccaaaacctcattcgcatcgagctcatcgagcgagacggtctgcctgagcagcaactgctgctggatgcggtcggcctcaatggaggcgatctgccgggagaagacgatgaaccagccaaggaacagcatggcggccagcgcctccacattcgtcagcgtattgtgacctttgagccacatgacaccctccacggcgcagaccaccaaggcgagatcggaaatgacgaagaacgatctcgacagctgcggcgccagccaaggcagtcctatgagcatgacgaacatcacgcacggcatgccacgggcgaacacattatgcagaatcggatgaggggtatagcggaagcagccgatgccgatgaagcacacgccacacagcacaagcagtatggacaaggcgatgatgcgcgccctgaacttcggcacatggtatgagaaatgcggattgcgcatgtgcacggtgccatgaggacccctcactcggtaggtggcgatgagctcggaaaccgcgaagtaactgatgatgatgatgcagataccgcccagaatgagcgtcgagttgaacatacgggcagcaaaagtggtacggtcacccagttgcgagaaattgttattgaaccaataggggtcgttggtggtgaaacttgcagtgcagacgcctgaaataatgaagaagggcagcagtgacgccagtgtcttggcatccatcaattccgcctgcacaaaggtgaggtaaccggataccccggcgaaagccgcacatatggccggaatataggtgctgaatacggttttgcccatggcaccgttcatcacgttgaacagcatgtacgaggtgaggaagagcgtggaggcgtagacgatggaaagggcgagcacctcgaatatgcggcgcagatggaacatccaaatgccacggaacgtgttgtaactcctgcgccgcaggtatccggcgatgaacgaggccacaccgcatgccgccacgattccggcgcagaccatgaaccggcgctgtgagatctgccagaaggctgaagctgcctgcatgtaccaatacatgccgaatccgcctatgatggcgcaaatcacgaatgagatgaggcccgaggcctctgcccgttgatgacgtcccatatcacctcgatcttccgacaccccattgtatgcacaatgtcagaccctgtgttatagttatttcctgtgcttgacgggcttctacgccccgagaaggcacattcgggctgtggcgcagcttggtagcgcgtctgctttgggagcagaatgtcgcaggttcaaatcctgtcagcccgacctagaactcctgcagtcgccgtgagttttccatatgtccccctcttaggagcattttcacacggtatttcactggtaacgatacgatatgagtatgagtgaacagaacacaaccatatggaaggcacctgtggcgaccgcgcctatcgacgccacggtgaccattcccggatccaagtcgctgtcgaaccgattcctcattctggcggcactatctcgcaagccagtgcgcatcgagggtctgctccgatcgcgtgacactgaactgatgatgggggcattgaaggccttgggcgtggccttccaggaagacgcgacggaacccaccactgttacggtgataccccccgccgaagggttcactggcaataccgaggtgttttgcggccttgcgggcaccgtgatgcgattcgtgccgccgttgacattattcgccaagggaccggtgcgtttcgatggtgacgagcaggcctacgcacgccccatgggcccggtgcttgagggtatgcggcagctgggcgctcgcatagagttcgaaggtgaggaggggcatctaccatttacggtgacgccgcctgtgcaactgggcaatctcaaaggcaagccacagaaggtgcgtatcgattcatcggcttcctctcagttcatttcgggactcctgctcattggatcgcggctgcctgatggcttgattcttgagcataccggtgtgcaattgccaagcatgccccatattcgtatgacgatggaagacgtggatgcagccggaggccatatcgaaatgccacaacggggcagatggattgtggaccatgccgaattgcagatggcggctcatgtggtggtggagccggacctatcgaatgcagcaccattcctgggtgcggcattgatcgcatccggctcggtgcgtattccgaactggccggcacacaccacgcagccaggtggtttcctgccgcacattctgcatcggttcggtgcctccatcactttggggggtgaaccgttcaatgaggtgaacgattgcgaatgcttccccgatgattacaacggcattttggaagtgagcagcgatggtgtaatcgaaggtttgggggagtgcgacctttcggcaatcggtgaaataacgccgagtattgccgccatagccgtattcgcgaacgcaccgagtgtgctggtgggcatcggtcacctgagaggtcatgagacgaatcgtctggaggcgttggctaccgagatcaatcgtgtgggatccgacgctcaggaggaggcggagggcctctccatagcaccggttgcacgggacctgatgcacggtgcagtgatggagacctatgccgaccaccgtatggccaccttcgccgcgatgctcggattggcgattgatggcattgaagtaacgaatgtggagaccacgcgcaagacgattccggatttcgtgggtatgtggaatggcatgttgcgcggcaagtgacagtaggcgcccggaaaaatgtgaggggctgcaagacgaacggtcttgcagcccctcacattttttgtggagaatcagatcttgttgccgtaggtgtcttccccggcggtgacgatctcgttggcgcgctgtgcgatggcgagctcctcattggtggggtagacgacgacggtgacagtggaatccggcgtggagataatgcgcggttccttcgaacgggtgtcgttcttgtcgttgtcgagcttgacaccgaacggtgccagcttctcacacaccatgcggcgaacgatttcgtcgttctcgccgacaccggcggtgaaggtgagcacatcgaggccgccgagctgtgcggtgtaggcgccgatgtagctgacgatgcggtgcacgtagatgtcgagggcgagcttggcgttctcgtcgccttccgcaacgaggcggtgcacttcgcgcatgtcgccgaagccggtcatgcccatcatgccggacttcttgttgaacaggtcgtcgagctcatcgacattcatatcggcattgcgcatcaggtggaacacggcggctggatcgatgtcgcccgttcgggagcccatgacgaggccttcgagcggggtgaggcccatggaggtctcgatggggcggccgccgagttccgcggaggcggaggcgccgttgccgatgtgcagcacgatctgcttgaggcccttggcggcctcggcgtcaatgccgaggaactctggaatctgggaggagacgaaccagtgcgaggtgccgtgtgcgccgtaacgcttgatcttgtacttgtcggcgacttccttgttcaacgcataggtgctcgatgccttcggcagctgctggaagaaggaggagtcgaagacataaacctgcggaatctcagggagcagctcgcgcatgactcgcgcccccttggcctccgggccgttgtgcagcggagcgagcacagccagctcctcgaccttggcagtggtgtcgggggtcaccaaggcagggttcgggaaggtgtcgccgccctggacaactcggtgcccgacggcgatgatgccggtctcttcaaggctcgggccgtattcctcgaagaacccgagcacgcgcttgaggccctgctcatggttttcgaccttctcgtcgagctcgtgcttttcgccgttgtattcgtacttgtagtggccgtcaatcggttcgccgatcttctcgacgatacccgatgcgattccttcgccggactcgagatctaccagctggtacttgatcgagctagaacccgaattgataacaaggacggttttcgccattgtggcatcctccattggtgattgctctgccgctatgcggctttccaacacacaagattactcaatgtttgctacaaaacggtgaatgggtgccctctcgttctatatttcgaaaaagcacccatccacgtcatgaattcgcgagatggtgtggactattcgttactttgcgcttcgatggcggtcaaggcgatggtattgatgatgtcctgcaccaaggcgcctcggctcaggtcgttgacaggccggttgagcccctgaagcaccggtccgatcgccacggcgccggaggtgcgctgcactgccttgtagcagatgttccccgcatcgaggtccgggaacacgaacacggtgacattgccggcaatcgggttgccgaaggccttgaccctggcaaccgtcttcgaccaagcggcatcgaactggatgggaccgacgatgggtaggtccggtcgtttgttctgggcgatcgaagtggcctcgactaccagatcgacatccggtcccttaccggaacccaaggtggagtaggagagcaaaccgattttgggatcgatggagaatgccttggcggtctcggccgactggatggcgatgtcggccagctgctgcggatcgggatcgaggttgatggcacaatcggcaaataccgacacatggtccttgagacacatgaggaaggcacccgatacggaggagacaccgggtttcgtcttgatgagctggagcgcggggcgcacggtgttggcggtggagctgatggcacctgagaccagaccatcggccatgccgagcacgatgagcatggtgccgaagtagttcgtgtccctgagtgtcttcagagccacatcgggggtcatgcccttcttggcgcgcaattcgcacagtttgggcaccatggtgtcgagcagatgcttgtcgtcgatggagacgaacttcgcctgatcaagcgccttgaggccgagtttttcaccccgggcaagaatctcgttgcggtcgccgatgatgaccagatcgaccacattcgactgcagcaggtagttcgcggcggtgatgatgcggtcgtcctctccttccggtagcacaatcgtcttcttgtctttcttcgcacgtgcgagcagatcgtactggaacgcgaatggtgtggtcggcggtacgaaaggtgtgtcaagcacgttgaggagtgattccttgtcgacatgctcgtcgaaggcatcgagcgcggccttgacattcgtgtcagcggaaccgagttccacgaggggaagcggccacgtcggcaggtcgtagctcacgaattcgtcggtgagtgtgggcagcgccgaattcgtgcagtcggtgatgaacacgccgatcacttgggtgcctgcgttggcgaccacctcgcggcatgcgtctatcgtctcacgaatctcgtccggcgtgcgtcccatcgagctcactgagagcagcaccggagactgcaggtcggcggagacgtccgcattgaaggtgaaccgttcgggatcgcccacattggtgcggtctgatccgacgatcactcggatctgcggattgatctcggcattcgtgtcgatgaatttggagacgatctgctggcgggcattgtctttgtcaagacgtgcgtcatgcagtgtgacgccgacggcctgttcgcgcgtctgcagcacgctcaccaccgagaggagtgcatcggtgagattttcgtctgcctgcaccgccggtcggaatatgctggtcttcgcggtgtgggcgagcatatccaccacacccaatgccaccacgttccggccgtctccaggttcgggactgatgatgctcacgtttttgaggctcacgatgactcctttgaaatcgatgatctgcctgacgtgcgactgcgttgtgcacgcagaccattgtaactgggaagggggcgtggcagaccggttattttgcaattgccacgagaatgtgacgcaggtcacattctgtatgggtatgggatattcggcgttgtgtgatggatagcaaatggatagcaaaaggcccgggtgctgacacccgggcctttcatcggctaagcgatgagactatgctcactcgttgtcgccggcggtcgcggcggtggcggagagcatggaggtctcgtcgaccttgacatccgggtacacccaatcggtgaactcaggaatgtcatagccattgtcgacggcgaactggaacgcggtcttgcggaactcgttgagctcgttgatcttgtcggcatacttgtcggcgtcgatgagctcgagggccttggcctgaagggcgtagcgatccatgtcgttgacacgcaccatgtcgaacggcgtcgtcgtggagccctgctccttgtatccgacaacggtgaagttgtcgtggttcgggcggtcgtagatgaggccacgaacgtcctgggcataggagtggtaggcgaagaggaccggcttgtccgcggtgaacaggtcggcgaagtcctcgtcagacatggcctcgtcgttctccttcgaggactgcagcttgatgaggtccacgacgttgacgaccttgaacttgatgcccatcttgttgagggcatcggaagcggccatgatctcctgggtcgggacgtcgccggcggcggcgaggacaacctggacctcgtcgttgctcttggcgttggaagcccacttccactcggcggcaccagcctcgagctcggcgcgtgcctcgtcgagggtgatccacgtcgcggccggctgcttgccggcgaagattgcgttgatcttgttggtggacttgaagcacttctcggcgatggccagcagcatgttggcatcggtcgcgaagtagatgttcgtcacgtggtcgttgttgaacgtcttgttcagcaggacggaggtcacacccggatcctggtgcgagaagccgttgtgatcctgacgccacacgtgcgaggagaccaggaggttcaccgaggagatcggcttacgccacgggatctcgcggacggtggcctcgagccacttcgcatgctggttcagcatggagtcgatcacgtgcacgaaggactcgtaggagctccagatgccgtgacggccggtgagcaggtaggcctcgaggaagccttcgcactgatgctcggagagctgctcgacaacctggccggtgacggccatgttctcgtcgacgagagccgagaggtatccgttgtcccactgcttcttggtgacctcgtaggtcgcgttcagacggttggacgcggtctcgtcaggtccgaagacgcggaacgaatccgggttgttcttgatgatgtcgcggcagtacgcgccgagggaacgcggagcctcgacctggccccaaccgtggccgtattccttgacgccggtgatctcgtactgatcgagctcagggagcttcagatcctcgcggatgcggccgccgttggcattcgggttggcgccgatgcgcagttcgcccttaggcatgaatgcggtgacgtcctccttgatggagccgtcggcgttgaagagctcctccggcttgtaggattccatccagcccttgaggacttcgaagtgggcctcggtgtcgcgggcggaagccagcgggacctggtgtgcacgccaggagccttcggtcttcttgccgtcgatgaacttcgggcaggtccagcccttcggggtgcggaagatgagcatcgggtagaacggacgggtcatgtcgtcggtctgagccgcagccttgatatcgcagatctcgtcgaagatggtctcgaagagctcggcgaagcgacggtggatcgacaggtgatcctcgttgtcgaagccggcgacgaactcgtacgggtggtaacccatgccgcggaagaagtcgtgcagctcctcgtcggagatgcgggcgaggatcgtcgggttggcgatcttgtagccgttgaggtgcaggatcggcaggacgatgccgtcggtgcgcgggttgacgagcttgttggactgccagccggtggccagagggccggtctcggcttcgccgtcaccgatgatgcacgggacgaagaggctcgggttgtccatgatcgcgccgtaggcgtgcgacagggcgtagcccagctcgccgccttcgtggatggagcccggcgtctccggagcgaagtgggaaggaatgccacccgggtaggagaactggcggaagaacttctgcaggccagcttcgtccttggtgatgttcgggtagtactcggtgtaggtgccgtcgatgtaggactgagcggtacctgcagggccgccgtggccaggacccatgatgaacacggtgttctgctggtgatcggcgatcaggcggttgatgtgggcgagaaggaagttcaggcccggggtggtgccccagtggccgaccagacggtgcttcacgtcatcgcgggtgaagggctccttcatcagcgggttgctacgcaggtagatctggccgatagacatgtagttggcgacgcgccagtacttgtccatgccttcgatggcctcttcggaaaccggacgatccagcttctgccatggggtaccaataacaggattagtcatgtgtgctcctgtactcctgcacataaatgtgcgatttgtttattccgttgggcacgggcttcggcgctgtcctgcaggccggtctccgtgcccgatcgctgattatgttacgcgaatacgctgacctttttgcagtttttgaaacagtgtgagcgaatctgtgcgcataatttgcgaatttgggagattgctcgggcgatttgtgaaaatggaaaatcagtgaataaaggcgagaaacgttgaaataccaacgaatgcaagcgttttcgccgtcgttgtcgcgtgcggtttgtgaggatattgcgcggcgtgttgaaaacaagcgaacaatctggaaaatccttgtgattgcagtgcttgagcgcttaagacgacaccgatgcgacccgtggcatgtgcgaatttcaatgtctacttgcctgcgcacaatagatgtgttgtaatgcccgagtaatgaacctatatataaggggagcgtaatggcagcaggtcctgtccttgtcgttgatttcggagcgcagtacgcgcagctcatcgcgcgccgcgtgcgcgaggcgaacgtgtattccgaattggtgcctcattcgatgccggtcgaggagatgctggccaagaagccgtccgcgatcatactgtcaggcggcccggcgtcggtgtacgaacccggtgctcccaccattgacaagagcatcttcacggccggagtgccggtgcttggcatctgctatggcttccaggtgatggcccatgagctcggcggcgacgtcgacaaggcggcgctcggcgagtacggcaagacggaggcggtggtggacgatgccacgggcattctcgacagttcgccatccctgcagaccacttggatgagccatggtgtcgccgtgaacaaggcacccgccggattcgaagtcaccgcgcataccgaaggggcgccggtggctgcgatggaggatccctcacgcaaactctacggcgtgcagtggcatcctgaggtcaagcacacgccgttgggacaggatctgatcgagaatttcctgcatgattgcgccggcatcgaagccgattggaacgcaaggaacatcatcgacgagcaggtcgctgcgattcgtgagaaggtcggtgacgcacgggtcatctgtggtctgtctggtggagtcgattcggccgtggctgcagcgctcgtgcaccgcgcgatcggtgaccagctcacctgcgtgttcgtggatcacggtctgctacgcaagggcgaggccgagcaggtcaaacatgatttcgtcgcggcgaccggcatcaagctcatcgccgtcgatgcctccaaggatttcctcgatgcactcaagggcgtctccgatcctgagacgaagcgcaagatcatcggcgaaaaattcatccgcactttcgagaaggcgcagcgccaggtgatagaggaggccggtgcccagggcaaggaggtcaagttcctcgtgcagggcacgctttacccggacgtcgtcgaatccggtggcggcgacggcgcctcgaacatcaagtcgcatcataacgtcggtggtttgcctgacgacatcaagttcgaactgattgagccgctccgttcgctgttcaaagacgaggtgcgcgccatcggcaccgaactcggcttgccggacgagattgtctggcgtcaaccgttccccgggccgggtctgggcatccgcatcatcggtgagatcacgaaggaacgtctcgacttgctgcgtgatgccgatgcgattgcccgcgaggagctctcgaaggccggtctcgaccgcgacatctggcagtgcccggtcgtgctgctcgccgacgtgcactccgtcggcgtgcagggcgacgaacgcacctacggttcgccgatcgtgctgcggccggtcagctctgaggacgcgatgactgccgactggtcgcgtgtgccgtacgacgtgctcgccaccatctcgactcgcatcacgaacgaatgccgtcagatcaaccgcgttgtgctcgactgcacgtcgaagccaccggcgacaatcgagtgggaataactgacaaaacccgcaaagccttgaaaacactggggtcttaaagcggaaacggggcatttgatagcaaattgatagcagataccaaaaccggatttactttgttcactcccgtataacgggtggcttgcgggtaaatcctccatatcctaagaaaaaggtcttgctgactttcaccagtcggcaagaccttttttgttatttgtcttttctctgtttcttcaatccttttatcagagcatcgcttaattccttcgaggggactttggcccaccgctgggtggtgtcgtacttcgggtagttgtagcgccagcggtcatagtcctccttggtgatctccccggcctccaacttcgccgcctgttcccgccacgcaatcaagattttgttcagctcactggcttgacggcctccctgaaaaatatctgcttgcaggcaggcacgtccatccgcctctaccactttcagactgtaaacatcctccaaggcgaacagcgtatgggccaaacctatgtagttgtctatgtccgggacgctcaacgcctggggcgatacatctaaggcaataccgcacagaaaaaaagtgccatatatcgccaagtgtgatataacaaacttatggataaacagatgacgatttccgcattcagcgacgaactggcacaggtgcggacgaagaaaaaagcatttctcgaccagattgaacggatcgtcccgtggaaggaatggcttgccatgattcagccgtgctattacaaaggagagcgcggcaacaaaccctatccgctggagatcatgctccgactgtatctgctgcaaaacctctatgacctgagtgacgaggccacggtggcagaagccatcgacagccgcgcattttcggagttctgcggcgtcgattccagcaaccaggttccgaacggggatactcttggccggttccggaacttgctgatcaagaacggactgcaggagaagctgttcgctcaggtggtagcagcgctcatggaacgtggcctcattctgaaaaagggcaccattgtagattccaccatcatttccgccccctcttctaccaagaataaggaaaagaaacgggatccggatgcccaccaagtcaagaagggcaacacctggcactttgggtacaaagcgcatatcggcgtggacaaggacagcggactggttcacacagtggaagctacaccggcaaatgtccacgacgttgcggaagtgccgaaattattgacgggagaggaagaaacagtctatggagacagcggttatctcggcgcaggtaagcgcgaagatgccgtagtccgaaacaaagctggccggaaaatcaagtacaagatcaatcgtcgtccatcgcagatgaagaaactgagcaaaagcgggcagtacgcagcaaagaaagcggaacgggcgaaatcctcagtgcgagcaaaagtagagcatgtattcggtgtcgttaagaagcagctgcgcttccgaaaaacgcgataccgagggcttgaaaagcaacaagccaaattcaatatcatgtttgcgttggcaaatctgattctggctgacagaccctgtctggcagcttgagtcagtgcgcctttgcggacaaaaaattcggaggttatccacagtttttattcggcacctgctgtataatgcggattgtggcatttgtgcggtgttgccttaaataaaactataatcaaatagtgggaacaaaggattatgatagtcccttttgtaggggcttagttttttgtacccaatttaagaatacttttgccttatcaattttgacatatccccaaaaacagcactcacaaacaggtgtatgctgtatatgtgtatgtccgcaaattatcatccccagtggtaaaagtattttactgctggggatttttatgcccttcggggcagtaaagggaggacaatcacatgaaaataatcaatattggaattcttgcccatgtagacgctggaaagacgaccttgacggagagcctgctatatgccagcggagccatttcagaaccggggagcgtcgaaaaagggacaacgaggacggacaccatgcttttggagcggcagcgtgggattaccattcaagcggcagtcacttccttccagtggcacagatgtaaagtcaacattgtggatacgcccggccacatggattttttggcggaggtgtaccgctctttggctgttttagatggggccatcttggtgatctccgctaaagatggcgtgcaggcccagacccgtattctgttccatgccctgcggaaaatgaacattcccaccgttatctttatcaacaagatcgaccaggctggcgttgatttgcagagcgtggttcagtctgttcgggataagctctccgccgatattatcatcaagcagacggtgtcgctgtccccggaaatagtcctggaggaaaataccgacatagaagcatgggatgcggtcatcgaaaataacgataaattattggaaaagtatatcgcaggagaaccaatcagccgggaaaaacttgtgcgggaggaacagcggcgggttcaagacgcctccctgttcccggtctattatggcagcgccaaaaagggccttggcattcaaccgttgatggatgcggtgacagggctgttccaaccgattggggaacaggggagcgccgccctatgcggcagcgttttcaaggtggagtatacagattgcggccagcggcgtgtctatctacggctatacagcggaacgctgcgcctgcgggatacggtggccctggccgggagagaaaagctgaaaatcacagagatgcgtattccatccaaaggggaaattgttcggacagacaccgcttatccgggtgaaattgttatccttcccagcgacagcgtgaggttaaacgatgtattaggggacccaacccggctccctcgtaaaaggtggcgtgaggaccccctccccatgctgcggacgtcgattgcgccgaaaacggcagcgcaaagagaacggctgctggacgctcttacgcaacttgcggatactgacccgcttttgcgctgcgaggtggattccatcacccatgagatcattctttcttttttgggccgggtgcagttggaggttgtttccgctttgctgtcggaaaaatacaagcttgaaacagtggtaaaggaacccaccgtcatttatatggagcggccgctcaaagcagccagccacaccatccatatcgaggtgccgcccaacccgttttgggcatccatcggactgtctgttacaccactcccgcttggctccggtgtacaatacaagagccgggtttcgctgggatacttgaaccagagttttcaaaacgctgtcagggatggtatccgttacgggctggagcagggcttgttcggctggaacgtaacggactgtaagatttgctttgaatacgggctttattacagtccggtcagcacgccggcggacttccgctcattggccccgattgtattggaacaggcattgaaggaatcagggacgcaactgctggaaccttatctctccttcaccctctatgcgccccgggaatatctttccagggcttatcatgatgcaccgaaatactgtgccaccatcgaaacggtccaggtaaaaaaggatgaagttgtctttactggcgagattcccgcccgctgtatacaggcataccgtactgatctggccttttacaccaacgggcagagcgtatgccttacagaactgaaagggtatcaggccgctgtcggcaagccagtcatccagccccgccgtccaaacagccgcctggacaaggtgcgccatatgttcagtaagatcacttgatacaccacagcgaggaaggttattgcatttccctgtctttcgtggtaaaatgtagttgtaaaccaccagagaaaccaatctaattttaccgttgatagccatttccttgatagccaaatgatagcaaaagttcggcaagcccataggataaggataataggtatcaggaaaaatcaaatgatatcaaatctcccaaacaaaagcgtttagaattaagtttcattttgcgaatgggagtgaccccgccgatcatgcgaccatcgctcccatagcgtctttctttgcaggtggcgcccgccgaagcctatcttcggcgggcgccacctgtcgtcgttctgctatccagtatccagtttcttctcatggaaggtgccccggacgacgattacgacgtggacatcgatttggatgcgggcttcaaggtgggacgccatgacgtcgaatccatccgaagacccgaaccgggacgcctcccaaggggaggggggaatgcgatccgtatccgctagaagcgcgcccgcagtcgatagggcaaatcatgaacatgtgaccggcaccggaaagtgacataatccgattgtcggcaatgggctcgatatggtatcagccgagcagccagtcgacgatattgcgtatctcaatgccgtcagaggtcgtgccgagacggaatctgtcgagtgtgagcacgattttcgggaatgcatccgataacgattgcaaaggcgcgagttccctcgcgcgggtggattcttcgagcatcgtcccggtgacctgaatgtagattctcctgtcgaatcgttgagcgacgaaatcgatttcacctccacgcagactgccgacatgcacgttgtacccgcgtctgcgcagctcgttcgcgacgacgttctccaattggaatccgtagttttgtgaggagaaaccatttgcgatgttgcatagtccggggtcttcggcgtggaacttgcgatgtgtcacaaaccgctgaaggtgtcaggtataactgacatttctcggatttcaagatggtttgtcgggtataactgacggatctgtttgagggtgcatcccgtaagaaagtgcagccggtaagtggatatagaggatatggggtatacggttgcaggaagcgagtgaatggggtgtgatgatcgacaaccatggatgcggttacgggatacagtggtatgcgccgtgtgcttgtcatcggatgtccgggtgcaggcaaaagcacgttcgcgcgcaggttgcgggatgcggccggactgccgctgcattatctggacatgctgtggcacaatccggaccggacgactgtcacacgggccgaattcgatgagcggttgcaaaggatcctcgaggaggatgcctggatcctcgacggcaatttcgcgcggacgctgccgaaacgactggaatattgcgacaccgtgttcttcctcgacttcccgaccgacgtatgtcttgagggcgtcgagggatgtagcggtatgaagcgcgaagacatgccgtgggtcgaacacgaattcgatgaggagttccgtcagtacatcatcgactttcccgctgagcggcgtccgcagatggttgacgcgcttgaagacgccgccgcgcgccgcggtgtgcgtgtccataccacatccaaggcagagctggtgcaagcgctcgctgatgttttgagtggtcttgaagtggggcgggccagagcatgtctgacgttcatcatgtaccgttatgcgacatactgggcatcacggtgaacgaactgcttggtgggggaggaacttacaaaagtggattcccgtcagctccatcctccgtcgtctcatcgtatgcgagcgcgagggcaccatcgtctcctcatgtgtatgcgtcatcatcccgaatctgacgcggggtgtgcggccatacgcgttcgtcgagaacgtcgtgacgcgcgccgatgcgcgtgggcatggttatgctaccgcatgtctgaaccatgcgaaggcgctcgcgcagcaggccggctgctacaagatgatgctgctcaccggctcccatgatccgaagacactcgatttctaccgccacgccggctacagcagcaccgacaagaccgcgttcatccagtggctgtagggcgcgtccgtgtcacggtatcgcatccaccaccgtcgatatccgtttggcatcgctcgacggcgggatgatgtggctgtcaaccggaagtgaacgtaggatgcgcagctcccgctctctgcgctcttcaaggcacgcgatatacccctcatatccgcgcaacccatgcgcttcaccgtacccttgtgctgtgtggtagtcgatgacggcattgagccaaccatcaccgcgttcgtcgaggacaccgtcaatcgccgatttcgcgcccggttcgtcaatgtagatgacgacgggatgcagtggcgcgatgatcgccgcaatatcgctgatgtaccgtcgtgactcgtcctcgctcatgccgaaccgcatcatcgtctcgcacatcggattctgcagcaggacgcaattgaatacataggtcgtatcaggttcggcgtgggctgcgaacgcgcgccaagtatcgagtatcgtggcgcgttcacttgcgaaatcagggaagtcgtggtcgccgacatcggcgggatggtctgcggctccttcttcgacgcagacgacgttccttccgcgcgcttccaattcggcggcaaccatcgcagccgtcgtgcttttcccgctatctggcagcccttcgacgatgatcagacgggttcgcatctcatatgtgctcatgatgtcatggtacggcgaaggatatgtgggatgtgcagatgtccatgtatatagggtgatataaccgaatataaggtgatatatagtgatatatcgaaatgaaacgatatacaactcgctcgggagcatgttgtcgtcttttatgaattcatgatagatctggaggaatcgttgttttgagtccatggatggtcgatgcgctcaagcgcatgtgctggtgcgcgtcgaacatatgaggccggtgaatgatatgccgtatgccgcttcttacgcctcagcgggtgtcggtgatggatggtcatggaactcccgcatctccatattgatgaatctgctgattatctcgcgatagatcgcctcaaccacatccggattcgcgccgcaacgctcggccttacctcgcaccttcgcgatgacccgctccatacggttggtgtcacgtacgccttcctcatctttcttgaatgccgatgcttgcacggcatattggcctcgtccaccgatcaatgcgatggtctggtcatcgatggcgtcgatgtgcgaacgcacttcgtccagactgttgcactgcacggcggtctcctcttataagtggggattacggaagatacaacaaaacatgccgatatggattgctattcgataccataaccttatgcaacgagcacaagcagagacgcttcgatgctctggggaacagttcattcggctcacacgcgatgaatgtgcgcgcggtatggcatgctccttgcggcggttactgcgcgcatccttggaaaccggcaacccatactatggtgctgaatcatgactagtccaagcattcttcctgatgatccgtcgttgtgcattcctcccatggaatccgacgatgaaaacgagctgaacagccagaccgcgcataaccgagccatggtcgagtattccgcgcgctgcggttgtttccactgcggtggcatattcgcagggaacgaagttgcacaatggctgcaggaggacgacggcgaggacactgcgttgtgcccgtattgtggcgtcgatgcagtgattgtgggcaatgaacaatacccggtatgcatgatggtgctgagcaaactgtatatgcattggtttggcaaggaatataggcaacgtcttgaggctgccactgatatgcccacatgtggcagtcacggggattatctgcgcaagggccttccttctttgacgaatcacgacaggaaaatcacggtggtcggggagatcgaactgttcccattgtccgtgtatgacagggcagaggaactgtgcaatgagagccatcctccacgaccggttgaatatgatgacgtggacgtctacatgggcggcgtggtgaccgtgcatgcgggattcgatgaacacggatattattactgtgatttcatcaccggcagtggcgtcaagctgccttacgatgcttggaacgacgtacagcaggatctggtgttgaatctcagcagacaatatggcgatgcgctgcgcggaatcatcactgattcattgatgcatcacatgcgattgttcattgatgtggatgtagcggaatgattagagcccatgttgtgtccgccatgtggcaagctgcgcatggagctgtgtcttgcggtcatccgaggcgaacgatgcgtcgatggagttcttggcgagcgatgccaattcctccatcgacataccgatgtcggcgagcgcggcatagttcgccgcggcatagcctccgaaatatgcggggtcatccgagttgatcgtgcatacgaccccttcatgcaggaatctgggaatcggatgctcgcgcatgtcgtgtacgacctgcagcctgaggttggacaacgggcagcaggtgagcggaacgccgtcgcgtgcgacgcgctcgagcagctcgcggtcgtcttgaatgtggatgccgtggtcgatgcgctcggcgtgcagcagattgagcgcatcgcggatatacgccgccgggccctcctcgccggcgtgcgccacgcaatgccagccaaagtcccttgcccgcgcgaactgatcgatgaattcggccggtgggtagccgacttccgccgaatcgagcccgatgccgagaatctcggtttttcgcggcgccgccatgtcgaggatccggttcgccgaatcgatatccatgtcgcgtacgatgctcagaatcagaccgccgctgatgtcgaagcgctcccgtccgatttccaatccctcaagaaggccgtcgagcaccatgtcgaaatccaatccgttcgtgcacacatgcacttgcggatcgaagaagatctccgcatgccttaccccgttcgcattcgcccgtgtgagataggcgagcatgagatccttaaaatcgtccttggtcttcagcgtcttcatcagcgcatagtagagctcgaggaacgactgcagattctcgaattcatactgcgctcgcaggccgtcgatatccgtccacggcaatgtcactccattgcggtccgccagcgtcagtgcaagctccggttcgagcgttccctcgatatgcagatgcagttcgcttttcggcatcgtctccagtgcctgcctgattttcccgtccaccatgttcctcgttccattgcgatatcggtttccaatattctacccactccatgttgtgccggggcgccgttcagacggatttggtggatttgatgagtcctgtgacaatcgaggcgattgcgcagaggaaaccgccgatcacccaggacatccagaacatgccgtgcggtccaccgtcaaagcagaacagcaacgtgaggccgactatgggggccgtgatcatgatgatgccgcataccgctccgttccccttgtcgtagattgactccgtcccattctcctgcacgtgttgctcctccgattccttgttgtagtcggcgatgtcgagccgcccatactgcatgccgccgaatacgatgcaccacacgccgaccgcgacgaacatgaggagcgccgtactgggccagccctcgtctacgtggagcgtctcatcggcccatacgttgacggcgatgccggccatgatgagcgcgatgcctgcgatcagtgcgatcgcgagcaccttgcgggcggcggcacggtccgactcggtatagaagtcctcaacatagggatgctgacgtttgaacgcgctgtgtgccagaccggcgggaatgagcagggcgagaccgacgagcgtgcctatggcgatgcacaggaacatcgccacctcattcgcatcgctgttgcccagaatcgaattgtccgaatcgaacaggttgccgatgctgacgccgaagatgatggctgacactcccgtgggaatcatcaggtcgaatttgcgcatgtgctcctcgtagccggtgatgtcctgaggcaacgccgacccttccatctcaggcatcggtgcttttgggagcccatcctcgacatgattcgccgacatggcaattccattgcgcacgtcacccatgaccagatcatcgagactcacgccgaacatatcgcatagcatgagcagcttgtccatttcggggtacgccttctcgctttcccacttgctcacggattgtcgtgacacgccaatcagcattgccagctgctcctgcgtcatattgtgcgatccacgcagatactgcagattgtctttgaagcccatggtcctgtccttttccttcgcgcctactcgtttcggcaaccgtcgcgggtgccgatgcccctactatgcccgaaatgcggaaagcgcgccaccaacttgcggttgcatttgctccgacaaccggcgatctgatgtcaacttgcggttgcattgctggaattccaatgattgttcacgtctttcatcatcgtgtccacatctcgtcatatggaatgtcgcgcaatatgtctgtgaacatgcctgtgagccaacacgacagagatatgcactgttctatctgttatatactgttatatatcgagcttggacacattgtattctcgcgttcgaaaggaggggagatgcagcttctgatcagtaccacgtcgatgacgccaatctatgaacagattgtcgatcagattcgtgcactcatcaaagaggggagactcaaggcaggggagccgctggattcggttcgctccctcgctcgtacctgcagaatctccgcactgacggtgaagaaagcgtacgacgtgcttgaacgggagggactcgtcgtcaccgttcagggcaagggcagctttgtcgcgcagatctcgccgaacatcgtcgccgaggagctcaaccgccaggtcgaggagcaattcgcgcaggctatcgccaaagcccggcggcttgggctgacccgcgaggagatcctcgagcttgtcgtcatgctgcttgaagacacctccgcggattcgggcgacgcccccgaagggactgaaggagcatcatgaagattgcacttgaccatgtgacgaagcactacccggatttcgacctcgacgtgacgatggaggtgccggacgacaccatcaccgctctcatcggtaccaacggctccggcaagaccaccacattcaggctcatgctcggacttgcgaggccggctggaggggaggggatcattctcggtgatcccatccgccgggtgtgggtgaacgcgaaatcgcgcaccggcgtcaccttcggcgacagcacgttcgtgccgaccttcacgctgaacgatgagatcgccgaacgcaaacgcttctatacgacattcgacgaacaatggtgcagggcacagctgcagaggttcacgcttccgctgaaccagcagattcaggaattctccgcgggcatgcttgccgaatgcaaaacgatcatggcaatggcacatcaccccgaaccactgatcctcgatgagccgacggccggtctggacgtcatcgcccgtaacgaagtgctcgacctgctccgcgaatacatggagatcccaggccgttcaatgctcatcagctcgcacgtcgccaccgacctggagaatctgtgcgacgacctctacctcattgaccgcggccgaatccgcatgcacgagaccatcgatgcattgcacgatgaatatgcggtgctcacgctcaccgacgatcagatgtcagctgcagacccacggtacatactcgtcaaacagcgcacggccggcggctggaaagccattaccgacgaacgcggattctatgaggagaacttgcccggagtggggatctgtggggcgagcatcgatgagatcatcacgctgatgagtgccgacccgcgaaccacaacgatgcaggaaaggacaatgcaatgaaaggtctgttcgtcagagacgcaatctggcttggcaagcaacgcatgctgctggtgtgcatgctggcgttgaccgtgttctacctattctccgacctccatgcattcggtgtggcattcctgccgctcatgctggcaatgctggtatgcaggacagtgcagaacgacgtgtcacgggcatgtcggcgcatgttcttcacgatgccatttaatacccgtgattatctcatcgagaaatactgtggcgccatcatccctccgatgctcctgtcgcttgtgctcatggcccttggcacattgagcccgcagatggcatggaatcaggtgcctgttgccttggtgatggtcctggcgacggtgtcggtgacggtggcggttgaaatccctatcattctcgccttccgtgaccgtgccgcggtgatgcgcatcgtggcgatggccgtcatctttacgatatgcgtactcgtcgtttccgtcacaaacaatcaggacatccttgtcgccctgacctccattccggacggcctgctgatgctgattggcggtgttgtctgcttggtgtgcacggccgcatcagggtcgatatcccatcgcctactcagcagagccgaatggtgattgtcggagactgtggttgtgatgcagacaccatcatgcacacaggggcatgaggggcttatcatggcatggggcatgcctgggaggcggcttgggtatgctcggcaccactgtgacgctctacaatactctcgacgaactcggcatcgactacaccgaagtcacacaccccgcggttacgacaatggaggccgcacaattcgtcagaacgctcatcgacggcaccccgatcaagaatctattcctcaccaatcgaaaaggaaactactatctcgtgctgatgagcgaggatcggcgagcggatctcaaggctctcgcacagatcatcggtacgggccggctctcatttgcgaatgccgacgatctgcggcgcgtattgaacctcgaacccggatcggtgactccgctcgcactcatcaacgatgccgaccaacaggtcgaggtgctggtcgatactgcgctcgcaggacagcgtctgctcatgcatccgaatacgaacacgaaggcgatgagtcccgaatacggggatctgctcaggttcattgggcacacgggccacggttacaggttcatctaagccgcgcaattcttcggagctgccaggtatgcggattacgaccgggttggcatccacgcacctcgatgctgaaatggattcgtaatcgtcatgtcacagagaatgttcctctcttggctatcgtgctcatgtccatgtctgcatgacgatgagggaacggagggcatatgaggccagtagtcgcggtgatgccgttggtggatgacgaacgggagagcctatggatgcttcccgggtacatgaatgcattgcgtgaggccggtgcagtgccgttcatgcctgcattgacgaccgatcgacaggagatcgggcagatcttcggcatgtgcgacggccttgtgatgactggtgggcatgacgtgaatccggcatgctacggtgaatcggaccgatacggcaatctgcactgctgcgatgcgcgggatgagatggaactcgcgttgcttgaacgtgccgttgcaagcgacaaaccggtgctcggcatatgccgtggtctgcagatcatgaacatcttctgcggagggacgctgtatcaggatctgccgagcgaacatcccagcgacgtcgatcatcatcagcacccaccctatggtcggccggcccaccatgtgcacattctaagcaggacgcccctgcgagaagatttacacgacaccgaccttgcggtcaacagccggcatcatcaggccatctgcaagctgggcgaggggttggatccgatggcgatcagcgaggatggtctcgtggaagcgatctacaggcctcgaagtgcattctatcgtgctgtgcaatggcatcctgaacatctatataaagtagacgaaccaaacaggtgcatattccgctccttcgtgaacgcctgcacactccgagattgaatgtggcagtgcgcgggccaatccaatatgccacaagctacgggcgtattggatgtaaatgtcgttagcatggaggcaacaggacacggcaactgacgacacctacggacgcgaacggatatggcgatagacaaaccaaaccatgagaccatgttgcaatgcttcgaatggtacctgcccgaaagccacaacctatggagatggctctcatcgcaggcgccgagcgtggcccatgccggattcaccacagcttggcttccacctgcgtacaaggggcaggccggcgattcagacgtgggatatggcgtctatgacatgtacgatcttggagagttcgatgccaaaggctctgttcccaccaaatacggctcccgcatggagtaccttcaggcgattcgcgcgatgcagggcaatggtgttcgtgtattcgcggacatcgtgttcaaccaccgcatgggtgccgatggaacggaacccgtgcgcacacatgaagtgaatgtggacgaccgcacgagaagcgactccaccgtggtcgaacgcaccttgaacaccgtatacgatttccccgaacgcggcggcgtgtattcgacattcaaatggaactggagcgatttcaccggcaccgattacacgaccgatgatggcacgacgggcatcatgcgtttcgacggcaagcagtggagcgacaatgtgagccatgaacgcggcaacttcgattacatcatgggagatgacgtcgatgtcaacgaacctgaggtcgccagagagcttacggattggggcatatggtatacgacgaccacaggagtggacggcttccggctcgatgcggtgaaaagcatcgacgccggattcttcgcgccatggttgcgcacgatgcaacgatacggcaatcatcccggcattgccgtgggtgagtactggtcgggtgacgcgagcgagctgacctcgtacctgcatgattgcaaccattgcatgatgctgttcgatgtcgcgctccatttccgcttcgaacaggcctcaaagaacccagagggattcgatctgcggggacttgccgcagacacgctgtatgagcgtgaaccgacgtatgcatgcaccttcgtggacaaccatgacacacaacccggtcaggcgctcgaatcctgggtgcaaccatggttcaaaccgttggcgtacgcatgcattctgctacgcgacaacgtgttgccttgcgtgttcttcggcgattactacggcgtaccccacgatctcatcccgccaatgaggttcctgccgcacatggtgtggatccgcgcgcatctgctgggggatcaggtggaggcgcagccaggcgataccgcccattcgctgtgctgggtggtggaaggaaatcacccggtgtgcgtggtgctcaacaccgggagcagcgaggtccatcgacaggttcgcaatgcggcgctcgcctcgcacacgcttatcgacgtatgccatcctgatgccccggcgacgactgacacgcaggggcagggcatgatgcgatgccctccgcggtcatgcgccatctatattgatgcggacgattatggggtgatgttggaagcgttgtccggcacgcccgcagctgggactgtatgcgcctgagagcataggtgcgccacaagcggagtctatgcctctagactaagaataaccggccagctatgcgctaatgtctgtagaggttgacaccggggaggagagggagacaatgacgaagcaacacaagggcggtgcagattcaccagtgtctcccgatacgcagaatccaggaagcggaaccagggcacaggatggtttggcagcacacgcccacaatgcggcaatacgcgcacaagtccaccggatgcaggcgatagccgaggaggatgaccgcttcggctatgacaggcatgcgaccaaccgggccctgagcatcgcaaatggtgtgaccgtcatcattctcggattcgcccttggaagcttcctgcaggcattgccggaacgcaacaccgccgacgtgcaggaggtggtcaaagggctcgatcggctgattggcctcatgaccaaggaattggtggagctgccgcatatccagcggcatccggaatcgttcattgcggaaatcgttggaatcctgatcggttacacgattctcaagcatgcgcatgaggacagccgggaatacgacgccgcattcaatcggatcgagcagttctacacagtgtcgcagaggcgccgggggtggattcgctgcggggttctggtggttctgggcaccgtggtgattctcgtcacccatggcctgctgctggcttacggtcatggcatgggtgacggcatcgccgccggcattgcgcagaccagcatcgcggcgggggtgtggtgttatgtgtatgggggtctgtacgcaacgcgcaccgatctgttcctctataatttccgtgcgttgcgccaagtcaacgtctacgagctggggaaaagcgaaagcgatgcgcgccgtgagatgagactcggagagaagaggctatgcgacttatcgtcgtcgctcaccaacttcaccgtggccatcggtgtgctcggagcgctggggctttacttcctgcccaccttccgttcacagtacttctggcttccactcgttgtgatgatcggcatcgctttgtgcatgcggtggttcgtgatccgctatgcgcggcggcggtacgaacctgatttcgattagtttcccatatacgccgcggcgccggcgagcaggcgcgccgtgccgccgatgaccagatcggcgcgggtgccgagattcatgcgtacgaaccgggatccgttttcgccatagatgccgccatacgagagcacaagaccggtatgtgagcgcagaaaaccgcagaagcgctcagcattggcgtcacccacacgatcaagaaggcccgagcagtcgatccatgccagatacgtggaatccgaggccaccatatgcagcatgtcatgtgcatgctcgtcaagttgcgtcgacacgtagtccttgttgcgctgcaggacacggcacagatcgtcgagccatgcgcctccatctgcataggcggcgattgtggagaacacggcgaaatcgttcggcccggccacctcgtcggtgttcacgccgcgcacggcacgtgcccggagaccgtcatcgtcgcagatgaaatatgcggactgcagtccggccacattgaaggccttcgatggcgacgagcaggtcacgcagattgaacggttcagctcgttgaccgcggcgaatggcatatgggtgacgcccgggcgcacgatgtcgccatgcacctcatcgggaacaaccgtcacatggtgctttgcacacagttcccctacgcgcgccagatcgctgtcgctccacacgttgccactcggattctgcggattgcgcagaatcatcagacgggtgagcggatcggcgagcttgcgtccgagatcttcgaaatccatcgagcacacaccatgctcgtatcgcagcggattgttcagtacacgacgtacgttgttcactagcgaattcgtgaagatgttatagaccggcggttggagcacgaccttctcagccacattcgtcagcgagcgcaccagcgaggagatcgccggaatcacaccggtggtgaacaccacatgctcagaatccaccgtcacgccatactggcgtagcgaccaatccgcgaccgcttcggtccattcccggggaacatccgccgaaggtgccgttgcccacgcgttcagccaatgcctcgctgatcgccggagccgtgcggaaatccatgtccgccacccacatcggcaactccccatcggccacgtcccatttcatcgagaagatgcccgtgcggtcgacaggggagtcgaattgtgcaatgcgctcgtcaatgtccatgttgtgcctcgctgctccgtgaatcataggtctgtgctgatgagctggatcttcgtcgtgtctatcgcggggtcgttctgcaggacgtcgccgaatgcggcagcgcgaatcacgccggaaatcgggttgaccacgctgtcgatgcgtgtggtgacgtcggcgtcgatgtcggaacagtattcgaacgagcgcgtcgtgttgatcagacggcagtctcgcatcgtcagcccgtcaatgtagcacagtccctgcagcgattcgatggtgcagttctcgaatgtgatgttcttcgtgttccatgccaaatactccccgctgatgaacgagttgcgcaccgtgacattctcgcagttccagaaggcatccttcgaaatcagacgggcatgatccaccgtcacgttccgtgcgccgtcgaaacagtaattgccggtgagctgaaaatcgcgtatgtccagattctcactgttcatggcaaagtagtcgccggcggcgctcacttcgcgcaatgtgaccttcctgcattcccagaaggtctccgcggcatcagtgaatgcggtgcgctccacggtcacatgctcattgcgacggaattccttgggtgcctggatggtgcagtcgtggaacgtcatgttcttcgagtaccagaacgccgcgtgggcattgaattcgaacagactgtgctccacctcgacgccctcgctgtaccacagcggatacttccagcggaacaccgaatccctgaccacgatgttgcgtgattccttgagcggcgactcgccgtcctcgaacacgcaatccgtgatctgaagatcacgaccttggaacagtgcgcgttcaccactgagcagctgttgcgtaatcgcttgcatagcatcttttcagactcgtgtatctcatacaatacgcgtgcggcacttgcggattcctcgatttcgtcgtcgcctcattcgaagttggcatcatcggcatgcgtgtggggaatggcatatgcaatcttccgccgtgtgaaatgcgaggggccgacggcattacaccgtcggcccctcgcattcatccggattcttcccgattccgttcacttccggttggtcgcaggagtagccaggaaacggtcctcgctcgggaggacgagattgagcaccacagccaccacaaatgccacggcgatgcagttctgcgcgaagatcgactggaacagcggcgggaaatgcacgaagatgctggagacctgcgtgaaaccgatgcctatggtgagggagagcgcggcgatcgtgatgttgcgctgggtgtatccggcatcggagatcatttggaagccggagagaatgatgttgccgaacatcatgatcgtgcacccgccgagcaccgcctgcggcatggaattgaacacctcggatatggctggcacgaagctggcgagtacgaggagcaggccgccggaaagaatcaccttgcggttgaccactttcgtcattgccacgagaccgatgttctgtgcgaaggaggtgagcggcaggcagccgaagagaccggagacggacgagatgaggccatcgcccgcaatcgcgccggatgtctcctttgcagtcggcttgcggtcgagcccgaccttggtcagggctgccgtgtctccgagcacctccactgaggaaacgatgtacagcaacccgatcgagatgatggagccccagtcgaactcaggcctgaacggcatgaatgtgggtacgttgaccgcctgcaggtgcgagaagccggagaagtcgaccttgccgaagaagatggccacgatatagccgaccaccagtccgaacagcaccgaaagctgcttggcggttcccttcatgaacagttggaacgccagacatgccaccagtgagatgaggccgagagtgagattctgccagctgccgaaatcctcggcacccgctccgccgccgaagctctcggctcccaccgacaacaatgagaatccgatcgaagtgaccacgatagccgagacgatgggtggcacaaaacgctgccagtacctggcggtcagaccgagcaccacctcgagcagaccgccgaccatgacggcgccgaccacggcaccgtagcccttgtggctcacaatggagatggcggcggcgacgtaggtgaaggagatgccggtgaccattggcaatctggagccgaacagccagatgccgtatagctgcaggcatgtgcccagacctgcgacgagcaggccggcctgaatgatcttggcggagtcctgcgggctcatatgcccggcggctgcgaccaggaagatcggtgccagattcgccacgaacatggcaagcacatgctgcaggccgaacgggatgcccttccagaacgagacgggcgcgtcgagactggacagcgcttcgaaggagatggaccccttcctcttttcctcggcgacttccgccttggattcacgctcgtcgcgcttcagctcgggggtgacgaatgtgcgttcctgatcttcatccgagcgcatgttggcgtcggatgcggtggggttggcgttgttgctcattcctctgccgtttctcttttcttctattgctctctgtgttcttcgataccaaaacgaatacacgcataccagcgtgatcgacgtcgatatgcgtgtattcgttgcggaacaggtaacaggctacagccggtatgttgcgttctgtcagtggcggaattcgatcgccccggtctcggcatccatcgattccacgatggccagtgaatccagatcatagccggcctcacgcagggcgtcgccaccaccttggaatcctttctcgatggcgatgccaataccctccacgatcgcgcccgccgattcgcacagttcgatgagcccgttgagggccttgccattggcgaggaaatcgtcgatgagtagaacgcggtcgcctgcattgaggtacttcttcgagacgatcaccgggaactccttctgcttggtgaaggagtagacgtgggtcacatactgttcgccgtcgagattgatggactgcgccttcttggcgaacacgaccgggacgtcgtcgaaatgggtggcggcgacgcaggcgatgccgattcccgatgcctcaatggtgaggatcttcgtgatgtgcttgttgttgaaatgctcggcccaggcggcacccatatggtcgaacagccgcacatcgcactgatggttgaggaaggcgtccaccttgagcacattgcccggtttcactacgccctgttctcgaatacgttcttcaagttcctgcatgtcgaccctttgctctgctgttctgaccgtgaaacacgccatgacatggcgtccgtatggcgcatagcatacgccgcccaaatgaccatgcgcatacgggtgggccatggcgttgtgttgaacatggactgtggtacaactgaaagccgaattcgtgatgtggagaaaggacatgcgttgccacaggacgttgatttcatcgcccgtccaccccaagagctcatcggcgatctgaacgagcagcaggcccaggcggtgcagtaccgtgggcccgctctgctgatcggcgccggcgcgggatcgggaaagacgcgcgtactcacgagacgcatcgcgtggatcctcacccaattcggggcatggccaagccaagtgctggccatcaccttcacgaacaaggcggcagccgaaatgcgcgaacgtcttggcgcattgatcggcggcgtggccgatcgcatgtgggtctccacgttccactctgcgtgcgtgcgcatcctgcgtcgggacggtgagcagatcggtctcaaatctggcttcaccatctacgacaccgcggattgcgagcgtctcatcaagctcgtctgcgctgacttcaatatcgacatcaaacgcttcaccccgcgatccatcctcgccagaatcagcgactacaagaaccagctcaccgatgcgagcacggccttggctcagtatgctcccgatttcaaacccggcatgcgtcactattccttcggccagataggcgatccggagccggtgtatgcagtggtctatgccgaataccagtatcgtctcgccctggcgaacgccgtggatttcgacgatctgatcgtgcgcacggtggagctgctgcgaacccagccgcatgtcgccgaatactaccgccataaattccgctatattctcgtcgacgaataccaggacacgaaccatgcccaatatgtgctcgtgcgtgagcttgcgggtgtggatgcccatgaaccaagtgatcccatggccacagaggccggaaagagcgggccggcgtgggtcactgtggtgggtgattccgaccagtcgatctacgcattccgcggagcagacatacgcaacatccaggatttcgagaaggacttcccggatgcgcgcacgatcatgctcgaacagaactaccgttccacgcagacgattctcgatgccgcgaatgccgtgatcgcccacaacagtgcgcgcaagccgaaaaaactgtggaccgcactcggcgaaggcgacaagatcatcgggtacgcggccgacaccgcacaactcgaggcgcattggatagcccaacagattctccacctgcatgaggagaagggattgccttacagcgacatggcaatcatgtatcgagcgaatgcccagtcccgttcccttgaggaggggctcattcaggcgcatattccgtaccagctcatcggaggcacgaagttctatgagcgtcgtgaggtcaaggacgccattgcctacctgcaggcaatcgtgaacccggcggatgacatcaacatgcgccgcatcctcaacgtgcccaagcgaggccttggcacgcgtgcggaatcacaactcacgctgttcgcgaacgagcacaaccaaacgttctggtgggcgatcgagcagcttgaggacatcgagggcatgagtgcccgtacggcgaatgcggtgcgcgccttccgtgaactcatgacgtcgctgcggacattcgccggagagcatgactccaagcccagcgagattgtggcgcaggtgctcgagcagtcgcatatgctggagctgctgcgcaaatccgaggatccgcaggatgaatcgcgtgtggagaacctttcccagctgcagtcggtggccgcggagttcgagcagaacacgccggataccacccttgcaggcttccttgagaccaccgcgctggtcgctgattcggaccagttgccgggggagggccatgacagcggcaaggtgacgctgatgacactgcatacagccaagggcctggaatacccgattgtgttcctcacgggcatggagcagggcaccttcccacattcgcgcgccatggagaacatggatgagctctccgaggaacgcaggctcgcctacgttggcatcacgcgtgcaaagcgcaggctgtacctgacacgcgcagccgtgcgcgcgcagtgggggcgtcagagcgaaatgatgccgagccagttcctcgacgagatcccggattccctcatcgactggaagcgtcgcgaagccggtatggagcgtatgcgttccggctggcgcaacgatggtttcgacgacggcttctccgacgaattcggcggatgggatgacggggattctgattatggtgcaggctcctatgggcgctcgagctatgggtcctcgggccgctcccgcacttcctcggggtcggctttcggttcccacgcctacggttcctcgggtacggcgtcgaatgccgctgcaggcaccgggtgggggagcgccgcgacgttcaaatcgagttcgggccagactgcatatggttcgggatcgtattcctcgggccgctcgcgaggctccggatcctctacgggtgcatatggagcccaccggtcgcatggaggttcctcatcatcccgttcctcggcttcccgttcgggtgccgtgcataccaggcacaccactgcaaagacacctcaatcacagggaatgcccatttcgcagattgccgccgacaatgatcttaatatcgcggatttccatgtgggagacaggatcacccatgaccgtttcggattgggcaaggtggttcagacgcaggacaagggcaagaactcggtgatcactgtagatttcggctccacaggtgtcaagcgacttatgcttcgtctggcacccatcgagaagctgtagccctgatgatctggcatcggagcgccgaagtctacaccttcacggtataatgcccatttggtgccttatgcaatggggcactgtctgggagtcttagcccatcagtgggtcggcagtcgcaagactgttcgtgcttggcacgaggaagcactggagaggctggctcagtccgacgccatatggttgccggattccgttcagacaacgacagaacaacgaaggaaacatcatgtcgaatcgttcccgccgtcaggtgcgtctttcccgcgccctcggcatcgcgctgaccccgaaggcacagcgcatcttcgaaaaacgtccgtatgctccgggtgagcatggccgtacccgccgccgcgccgagtccgattacgcggtccgcctgcgcgagaagcagcgtctgcgcgctcagtatggcatctcggagaagcagctccgcgccgcctatgaaaagggcacccacaccgcaggccagaccggcaacgcaatgctcaccgatctggagacccgcctcgatgccctcgtgctgcgtgccggcatcgcccgcaccaccgcacaggcccgccagttcgtggtgcaccgtcacatcctcgtcgacggcaacatcgtcgatcgcccgtcctaccgcgtcaagcccggccagaccatccaggtcaagccgaagagccagacgatggttccgttccagattgcagccgaaggcacccaccgcgacgtcctgccgccggtgccgggctatctcgatgtgaacctcgcctccctcaaggcgacgctgacccgcaagccggagccggaggagattccggttcaggtgaacatccagtacgtggtcgaattctacgcccgctgatctggatcaacatactgtaggaacatacggtataaggacatacatacacgaagaggcccgcggcatttgcccgcgggcctcttcgtattcgcaagccggcgtctcattggccgactgcggcgctcacgattccgctgaccagcgacatgatgagcgagccgagcaccgcccaccagaatccgccaatcgtcacgcctacgtcgaacagattgatggcaagccaggaggccagctccatgaacagccaattgatcaccaaagccagcaggccgaaggtgagcacgctgaacggcagcgccagcatctgcaccacgggtttgagcgaggcgttgaacagagccatgaatagtgagaaggcggcaatgccgagaatagggggatgacccaccacgtgcattcctggaagcagcaccaccatcacggccgccgctatggtgagaatgaaccatcgaatgagaaaattgcccatcaccccattatgcccgaagacgtccacaggcgaaatacgacgtccgggcgtcacgccgtgccataatcgaagcatgatcgtgcatgttcatctcgtccgtcacggacagacattcttcaaccgctacaaccgtctccaaggctggtcgaactcaccattgacgcaagccggactcgacgatgccatccatgcgggcaatgcattgaaagacatcaccttcgccgcagcgtattgctcggacaccaccagagcacaggtgacggcacagacgattctcgatatcaatgcagccaatgggcatgacgtgccggtgattcatgccgacatgcacttccgtgagcagttctacggctatttcgaagggcaggacatgggagcggcctggctcgcagccgggggcccgcacggtgctcccacctaccatgccatagtcgagcagttcggactgggtgccacccgggacttcctcaaggaggcggacccgttccacgacgccgagtccgacgaggagtactggcggagagtcgatggcgccttcgccctcattgcagctaacgcggaccttagggacggcgacgatgtgctcatgatctcgcacggcaatacgctgttgtcgttgatgcagcgcttcgctcctgcggggtacgacctgagcgaacgaccggccaacggctccgtgaccatgattgacttcgataccgtcaagtcactggacgatgccattgaggtcatatcgtataatcgacgctagccgtttaggtctgggtgattggataggctaaacgcgtataagtgtagacgcaaactgctaggaaagagggcgccatgggtgctggagaaattgcgggactgattgcggcgattgcatttgcgattcttgccggttttctgatctacccgctgatccgcttgggcaagatgttcgatcagatcgccgaaacggtgaaacagaccggcgaccatgctctccccgcattggacgagggtgtgaccaccgtcaagcaggtcaacaagtcactgggtgacgtcaatgagatctccggggcggcctcgagtacgatgaacaacctcggcgccctgatgaatctatacggttccttcctgggcaagccgatcatcaagctggcatccaccttctacgcggtcaaggtgacagcggcgtcgttcatgaacaaagggaagaaaaaccagcccgcatcggcggagcagaaaggcaagggcgagtgatgttcaaacgagtgttttgggtcgccgccggtgtggtgctaggcgtactcgccgtttccaaggccaccgcatacgtcagggccaacaccccggacaaagccaggcagttcctcctggggccggatcaggagaatgtggggatgcgtacactgcagggcctcatcgatcagttcaggcaggcccagcaggcacgtgaagaggagctcaaccggcaatacaccgcaaagctgagttgaaaaacacgcgaagccaatatcgtcagtagaacaccaatacaaggagacgcatcacatgcgcaccgctgaaatcgcacagcgttatctcaattacttcaaaaagcaggatcatctggtggtgccgtccgcatcgctgatctcgcccaatccgaccacgttgttcaccattgccggcatggtcccgttcatcccgtatctcatgggggagcagaccccgccaagccgccgcatggccagcaaccagaagtgcgtgcgcaccctcgacatcgaggaggtgggaaagaccacgcgtcatggcaccttcttccagatgctcggaaacttctccttcggcgattacttcaaagaggaggccatccattacgcatacgacctgctgacctcgccgcgcgaagacggcggcttcggattcgacccagagaagctatggatgaccacctacacggacgatgatgaggcccgtgccatgtggcgcaacgaaggggtggatccggaacacatccagatcctcggcatggaagacaacttctggacgaccggcggccccggccccggcggcccctgctcggaaatctacgtggaccgtggacccgaatacggcaaggaaggcggccccatcgccgacgaaagccggtatatcgagatctgggacctcgtgttcgagaactacatggtggacaacgtcaagtcgaaaacagacctgcacatcgccggtgagctcaagcacaagaacatcgacaccggtgccggtctggagcgtctggcatacctgctgcagggcaagaacaacatctacgagaccgatgaggtgtaccccgtcatcgaggcggccgagaagatcaccggcatcaagtacggcgagaacaaggaggccgacgtcagaatgcgcgtcgtggccgaccatgttcgttccgcgctcatgatcatgagcgacggcgtgcgtccgagcaatgcgggacgcggctatgtgctgcgccgcctgatccgccgcaccatcgaagccatgcgtgtgctcggtgtgaccgatccggtcatgccccagcttctgccagtgtcggaacaggccatggaaccgaactatccggagctcgccaacaccttccacgatgtgtcggaggcggcatacggcgaggaagacgcgttccggcgcacacttaccaacggtctggagatcttcgacatggccgtcgcgaaggcgaagagcacggccgaggaagccaagggggagaccaccccggttgtttccggcgatgccgcgttcaccctgcacgacacctatggcttcccgatcgaactgacgctggagatggcgcaggagcagggggtcaaggtcgacgaagcgaagttccgcgagctcatgaacgagcagaagtcccgagcccgtcaggatgccctgaagaagcgtcacaatgtcgatttgagcgaatacgacgacttcaagaacaagctgcatcagccaatcgagttcctcggatacacggaggtctccacccgcagccgcgtgcttggcatcatgcttgagggtgtcggttcggtgccggctgtgagtgcgccggcaaccgtggaggtcattctcgaccgcacgccgttctatgccgaggccggcggacagcttgccgatcagggtgagatcatctccgatgatggcgccgtgcttgaggtggacgatgtgcagaagccaatcaaggacctcattgtgcagcagtgccgtttgatcgaaggcacgctcgtggtgggagccgaagccacggcaaccatcgacgtcgaacgtcgtggtgccatcgcccgttcgcataccgccacacatatcgtgcacaaggccctgcgcgaggagcttggacctcaggccacccagcgtggctcggaggatgcccccaaccgcttgcgattcgacttccaatggtcgacggcacccaccaaggagctcatgagcgctgtcgaggcccgcgtgaacgaccgcttgcgcgacaacctgcatgtgagcaccgaggagatgaaattcgacgacgccattgcgctcggcgccatgcatctgttcggtgagaagtacggcgatgtggtgcgtgtggtcaccattggcgacgatggctggagccgtgagctgtgtggcggcacgcatgtggactttgcaggcaagatcggtcaggtgaacattctctccgaggcatccgtaggctccggtgtgcgacgcgtcgatgcactggtggggcagagcgcctatgatttcaacgcccgcgagcatgcactggtttcccagctctccgacacgttgaacgcacgtcccgatgagctggccgatcgcatcaacacattgctagccaagctcaaagactccgatcgccgccttgcctcgatgtacgaggctcagctggcgtcgtcggtgccggaactcgttgaggccgccgccaattcgaccgccccggtggtggtggtctcgaagaacgtcggccacttcggatcgttcgatgtgctgcgcaagaccgtcatggacattcgcggacggttgggtgacgacaaaccggtgattgtcgccctcgccggcgtgaatgaggacgacaagcctgtgattgccgtggccaccaatgaagcagcccgcaaggcgggggtgaaggccggcgacctggttcgcggcgcttccaagatgcttggcggcggtggcggcggcaagcccgatttcgcccaaggcggcggtgccgatgcctcgaagatcgatgccgcgctggaagccctgacgcaagaggcgatgcgcgcctgatgccgggaatctggctgggacttgatctcgggaacgctcgggtgggggttgctgcctccaaccccgagcgttccttcgcataccccgagggcaacattcgcgtatacggcgactatttccaggttttcgacgatgtactggaccttatagaagacaaggccgaagaaggcacacccgtgacggccatcgccataggattgccgctgcagatggacggttccgcgggaagcagcgccaaaaaggcgcagcggtgggcgaaatcgttgcgcagaagactcgagtccgaaatggaagaccaggactctcacatcggcgtgatgccggatatcatattcatcgatgaacgattgacaaccgtcgacgcacaccgtcgtctgttcgacgcgaatgtcagcagcaagcaacaccgagccgtcgtcgaccagcagtcggcggttgagatcctccagacggctcttgatcgtgcacgcgataacacagaggagttttgaagtgtccgacgacctgcatgatttcttcaatgccgacgaatcctgggacgatggcgccgaaccggcggccatgccacccgcccctccccatagcaggcgcgagatgcgacgccaacgcgcgatgaggaaacgcaggaatctcatcatctgcatcatcgtcgtcatcgccctcgccctcatctcggtcggcggggtgttcgcataccgggccgcacggaactggcgtcgtacgaacatggcccatgaatccctcgtcgaggattatccgggaccgggagacaccgatgtcgccttcaccgtcaagcagggcgagggcatcatggaggtgggtgccaatctggtgcaacagcagatcgtcaagtcggcagacaccttcgccacctatgtttcctcgaacgacaagacattgtacccggggacctatgcattgaagacgcatatgaaggcgtcacaggcggcggacatactctccgaccaaggcaacgcgaaaggcttcgcggaggtgcggcagggcgaacgagtgtccaccgtgatcgaacggatctgcgcagataacgacatcgacaagacacggttcgaagcgattgtcaacaacagggacgaggcgtcgaagatccttcccgcagaggcgaacggcaacttcgaaggctggctggagcctggcacctatactgtgggtgatgtcgcgaccgctcccgagcggctgctcaaagagatggtggacgcgcgcattcgcaaactcgacgagatgggcgttccccaaggcgcggaacgcgagcgcatgctcatcatcgcttccattgtggaggcggaggtgaactcatcggactactacagcaaggtgagccgagtgatctacaatcgtctcgacaaagacatgacgctcggcatggacagcaccgtggcctatggtgccagcatcaacggcatgcaactgaccaacgaccagttgcaagacacctcgaatccctacaacacccgtgtgaatcgcggtctgccgccgacaccgatcagcaatccgggtgatgacgccatcgaagcggccatgcatcctgccgacggcaattggctgtacttcgtgaccaccgatctgaagaccggcgagacaaaattcgccgacaccgacgaacagttccaacagcttgtgcaggagtaccggaggaacaaccccgacgcgaactgacgagcggatgcggaacctgaatttcagctgtccacggcggctgcgccccgtcatgcacaacacatgacggcaagtgcagccgccgttgctatcaccgggacgaacggcacccgcagacgtcccaccccatcaccggtgcgtccacgcgaacgtacccgggaatacacggaataggcgggcacccaacctacaccgagcacgcccatgcacagccagaaccacagatagcattcgagtccgaaataccccgtggcaaatcccgccatgccactggcagtgacatcaccaagaccaagcgcatggcgggggatcgccatggcgagcgaaagctgcaccccgactgcacccaccagcccgaagcaggcgcagacgaagggccacaggtcgtgcgagcgaatccccgctgtcaagaagaccacgcattgcacggccacacctgccatgacccatgggcgcggcacaatgcggcgcctcaggtcggtgaccgagatcgcgagtccacagaccaagctcggtatagtgattagccaatacatatggttaagatagtcgggattgacgtagaacaaaaggagtaggcatgttgcgttggcagaccgcaggcgagtcccatggcgaggcgttggtggcgatgatcgaggggatgccctcaggtgtgcgcgtgacatcgcaggacattcgcgatgcattggcgcgacgccgtctggggtatggccgtggggctcggatgaagttcgagcaggatcaggtgcgcctgctgaccggtgtgcgattcggcagcacgttggggtctccgatcgccatcgagataggcaacaccgaatggccgaaatggaccgaggtgatgagcgcagacccacttgaccatgaacttgcgcgcgagggacgcaatgcgccgttgagccgtccgcgaccggggcatgccgatctgaccggcatgcgcaaatacggtttcgacgatgctcgtccggtgctcgaacggtccagcgcccgcgagacggcatcgcgcgtggcgctcggcgaagtggccgcgctgttcctggagcaggtggcgggcattcgaaccgtgagccatgtgatctcgattggcggtgccggtgtggagagtgacaacacgccgctgccgggccctgatgacgtggcggccctcgatgcctctccggtgcgcacactggacaaggacgctgaggagcgcatggtggcccgcatcgatgaggccaaggcgaaggccgacacgttgggtggtgtgattgaagtcatcgcatacggtgtgccggcaggcatcggcacgtacgtggaatcggatcgtcggctggacgccgccctggccgccgcggtcatgggcatccaggcaatcaagggtgtggagatcggcgatggattcctggaggctggccgccccggttccatggcacatgatgagatggtgccaggcgatgatggctgcattgcacgcttgtcgaatcgtgccggcggcatcgagggcggtatgtccaacgggcagccgattcgggtgcgcgcggccatgaaaccgattccctccataccgcgcgccctgcgcaccgtggacatcaccaccggagaggccgcccaggccatcaatcagcgctctgacagcaccgcagtcccggctgccgccgtggtggcggaggccatggtgcgtctgacactggcccagcacctgctggagaaattcggaggcgacagcatcgaagagacgcgccgcaacatcgaaggctatctggcctcgtggccggagcacatgcgttaggcggttgcagggcatggcacataaccacaggcacgcgggcaaaccccgcaggcaaccgcaggccgtgatcatcggcatgatgggtgcgggaaagactcgactcggcaaggagatggcgcagatgcgcggtctgccatttctcgacgccgacgtggagatcgaacgcgagatcggcatgagcataccggactatttcgcacaatatggggaaccggcatttcgcgaggtggagcgtgatgtggtgtgcgatatcctggattccttcggcggcatcttttccctgggaggcggagcgccgatgacgaaggccatacgtcggcgcctggcacagtatgtggcccggggcggcaaggtggtgtatttgaaggccgacccacatgaagccatggaacgtgccaaccggggaggcggtcgccccatgctcacaggcgatgccgagaaacgctggatgtcgctgttcagacaacgcgaccccgtataccgtcaggtggcgaatctggtcgtgccaacgcggggtatgacgcccaaagccgcggcgaaaaggatgatagaaatggttgcagagcacactgtacatgttgatggcaggggaatcgaaccctacgatgtgcgcattggggaaggagcgttgagccacctgcctgaagtgctgggcaagcagcccgtgcgcgtggcgctcattcacacgcagtccgtgcagcgccatagcgaccgtgctcgcggactgctgcgtcaggcaggttatgaggtatcggacattgtgattcctgacgccgaggccggcaagaccatcgaggtggccaatgggatctggcaacggctgggcacggagggcttcacccgttcggatgccattgtgggcatcggcggtggggcctgcacggatttggcaggattcgtggcagccacgtggatgcgcggcatccgctacgtgaactgccctacgtcgctgctcgccatggtggacgcctccaccggtggcaagaccggcatcaacacccctcaaggcaagaacctggtcggttcgttctacacgccggccggcgtgctggcggacctccgcacgttgaccacgctgcccaacgacatcttcatcgaagggctgggcgaggtggcgaaatccgggttcatcatggatccgcagatcctgcgcatcctcgaggaccatgccgccgaactgcgcgcgttcagtggcgagacattcctgggcacgcctctggaggatgtggtcagtgagctcatcgagcgcaccgtccgtgtgaaggcccatcatgtgagcgcagatctccgggaggccggattgcgtgaattcctcaactacggccacaccttcggtcatgcaatcgaacagctcgagcatttccgctggcgtcacggcaacgccgtggccgttggcatggtctatgccgccgagctgtcgagcctgaccgggcaccttgaccgtgacacggtggactacacaaggtctctgctcaccagcctcggtctgccgacatcgtggaacggcgccggcttcgatgaggtcctcgcattgatgcatcgtgacaagaaagcccgtggcaacacgctgcggttcgtgggccttgaacaggtgggggagccgttccatctgaacgaccccgattcggaggccgtagaggaggccttccaccgtgtgcagaacccgtgaatggaatcggtccggcaggtgcgaggtgaatatacgcccagaatgcaaagtgggagccgaccacccatacacgctccggcctcgctatagtggagagcagccaacggcaacgaattggagggacaatggcaacgaagtcacagccgatcaaggtcatggtggtcaatgggccgaatctggggcggctcggagtgcgtcagccggatgtgtacggttcgcaggatctcgaggagctgcgtcgactctgcacccggtggggggtcgaatacggccttgacgtcgatgtgcgccaaaccgatgacgaagcgcagatggtgcattggatgcacgaggccgcggaccggcgcatcgccgtggtgatgaaccccgccgccttcacccattactcctatgcgttggccgacgccgcgcacatggtgctcgacgcggacctgccgctcatggaggtgcacatctcgaatccagccgcacgcgatgagttccgcaagcgttcggtgatcagcccggtggccaccggcacgatcacgggactgggttacctgggatacaagctcgcactcgaggccgtcgcagaactgaccaagagctgagatgaacgcggcgcgggaagcttccgctatccgtgtgacacctcaaggtgatgaatggcacggggacggcagagtacactctgccgtccccgtgccattcatcaccagatcctcagatcaatcagctcagtccggcttcccttccttcgctggtacgattccattggagtttggaattgtacccatgcggtgatgacgctctgtcgtcacgtacagagctgagggcatccatccaccagtgctcacgttcgatgactgtgcggtcgggcacgcgtgggtcaaagatgtcgaggatggagtactggaaatactgctcgatgtattccacgccgtgttttgcgacaaggtccttgagcagcgcattgccgccagtgtggtctccgttcgcgtattcctcccatcgggagagcagaccttgtgctccgccatggcggctgtatgctgatccgacgtagtgccaaccggtacgcgtgtcggtctgcagatacacggcgttgacggctcctagcgcgccacgccattcgtcgttatgcacagcggctacaagctcggagaacgatagccgcacgttgtcgtagccagggaatggcattgccgagaccggcgactgcgcaatcttctcgacgagcatcgtatcgaagaagcgagaacgcaatccggcatcggccatgccgttcaccatctgcgtcgcgccgcgcctcttacggtacacgacgacggtgcgcgcctcgaatgggaggaaacgttcgattggcttgcgctggtagacttcgtcattcccctgcatcaccgtttcgccgacctcatagcctccgatgaacaaccaatggatcgcgggtttctcccgtccatcgagctggatgaattgcagcaccttgggctgccgtatgtttcctccggccttgctgccgttccagcggcgtgtgaacacccaatccatgagctcgtcgtgatgctcgtaatacatcgtcattgcatcgaaccacgcgccgctactttggttcaatctgattgcatactccgaaagctcctcttcgctgaggccgagcatttcaaagaacctaattggtggattgttgttttccatgatatgttccttttctgtatcgtatggtttgctgtttccgctacacatcacgagacgttcgcaatcggcgacgcgcatgtcgataggccacatccagcgcattcgccccatggatcatcatgtcgaaccattcctcgccaatggtgaagctcgctgtttcgaataacacaagatcagccggttccgcggcctgcgggtgtcgtcggaaaacggacagggaacccgtcaatcgcggaatctggccaaggcacagtgaggggagtgttttcgggtcctcttcatcaaaggcaatgagttcgctgtcaaggtcgatgaaggcaatatgtgtgttcgcggcggttatggtgatttcgagcagctgcaccgtctgccatagtcggtctatggcctcgtcatagatgtttgtgccatgttcgtcgtcgatgagctctcgatagaacggtttgtcgtcgaacgccatgatgttcagttcgcggaattcgccgtctggcatgcccacgcattgcaggcgtgcgatggatgtgaacggaatcggtacggtttcggctctgtcgtccgatggcgaagtgaccgtccaatccgaccacgcgagcgtggacagccaacctgtgactgcctgttcaagttattttgcacgtagtgggcgtggaacaccggtgttctggcgaatgcgataacggaacccaagcgtggtcataggtgccttcttcgatgcgcggacagtaactttgcatcatgataacttatataaaagataaaatgatggcagacacgctcctttgcgtgtttcggcctgtctaccggctgttgaggattgtcatcttgttggtgacagattcaggcgggatgattgcgtgctcgtcgaagtaggcgatcgggttctttgagtcattgcgctcgaatgtcttgccaatccaaggttcataacgctctccggcgaggtctccgaggaaccacatacgcatgtcctcgcgcttgacgatgcctttgatcttggcgacgcagacgacgacgttgtccggattgaggacaatgccgatgtcgcatcgcacggcacggcctggttccagcttccaccatccggcgctgcagctccagacctctttctggctgagcccgtcgtgccagccgatggcggcgattgtgttgttgtcaggatctttctcgtcgtagtccaggattttccgcggtccgattttcatggtgacgatttcggccatcatcgcccttccgtgcaaagtacttcgttatctttgtaccaagatggagcaacattcgggcatgtcgtgaccgttgcgagctttgcatgtcggtttgacagggcgctgtggacaaattaggctggtttgaaaccatatcttttataaaagatataaagataggagtggcgatggggcgcagggacatggaagtcggcgatgccgtggccgtcaatgataatgggtgcaaagggataggattcgtcgtcgcatcctccgatgacccagaaaagacgggtggtgtgggagcggctggaagaacagcatatctgatccgatgggtgcttggcaagaatctgcagcacggcaccacgatgggtgcgcgcggtgagtcatggttgaatgatgatccgaagcgcattcgcatcgacggagtgcagggttataccatgccaaagcgtttcatgggcaggaatgtcgcaaggctctgtaagggcgacaacgagttcatcggcttgcctgcgccgcacgacgcgtcgatgcggatgccgatggtacgtctggccgcggtgtctgtcgtctgcgtgctcagcatcgtgttgtcgttggtgttcgtgcgcaaccgagaacagacgcggcttccgatgcagcagtccgtttccgcagagtcgtcaatcgatggtggggatgctgggatcccgggctctggtgctgataatccgtactattacgatgaaagttccggctggacacaggaagattcgaatgaagggtccgcacagtcggatacgaataccgcggacagtgcggacgatagtggcgccactgcggggaattcgggattcgatcccgacaacatcaggggcacatggtgcagaagcgatggcgtgacctgcgtcaagatcacgccgcagaccgaaggcaatacctctcctctcgtgttggatacgtcgcggatgggggacctcaacccactgccgaacggccagacgacaatcccattggggtatgtccatcaagataatcccaatacttcctctggcgcgcagcaattgatcacacagtatacttatcgcatcgattgcgaggtttgggcgcagtattacaacaatgtggcgtgcgacggtgaggcggtgcacacggtagacatgtcattgccagacgtacctcggtcaggtattaaattcgtacagagaccactttcagtaacacgagtgatttcaacaagtgattcacctatcgaaggcttggatgactcgaacccgcctacgcgagcagtgtaccttgttgttgagccttatgggggacgggccgctgattcggtatctgacgacacggtgttctattggaggtcatactagtggacgctactggaacgcttacgttaaggaaaggatgatcatggcacggcgcacaatgagggaacacgatgtcgtcatcgttgattactcggatctcaacgcgattgcgatcgtgacggatcgatccgaggatccgaagatcacacaggggataggcggccccggcgtacccgccttcaggctccaatatgttgctgggctgacgatggtcgaagacaaggtcgaaccggcggtgggtttcatctggctcaatgacgaccctgagcatatatcgatcgtcggcgtcaacggatgcctcctgccgtcgacattctatggcgtggacatggttcaggcgttccgggacatcggtgttgactgcggtgacggtacggagtctgatgatgcgtcatccaagctgatttccgacttcatatcaaacgagcctcttgatcaggtgctgtctgcggatgcgtggcgtttggatgattatccgccgcggcgtcgccttgatctgcttgccagagcacagaagacgcttgaattcactgacggggcgcgtgaaaaagcggccgatgaagtcgcaaccgcacggcaggcctttgaaaacgcctgtgctgtattgcgcaagcgacttgtatgggcggtgtggtgtgtggcgatcatcccaggtgcgtattttgcgatagcggcatgtcgagccgacgtggagacggctgggcgccttcgtgggatcatcacactgctcatggccattgttttcggcgttctgatcacctcggccatacgggaaggcaggttggcgaggaaaagccgctcaacattgctggcagcgttggcggcgcaaggcgtgcaggagaatttcacgtatgcccaggagctgaagatcgagccgattttgagaatgattccgcaggaataccgcgatgggactcagattggcgccatcatcgagctgcttacgagtcctgcgactcccgatttcgcgcaagctacgacgcaatgggatgcgctgctgcatcagtacaagatggaacagttgcacacgcggcaaggagaacagtccgatctgcgagcccgatatgaacaagatgccgagaccatcaggcagacggatctgtcggacgcctggaatgagttcgacgcgcaggaagcccgcacacagtcggtgcgtcaacgcaatgacgagttgcggcttgccattcagaggcgtggattggagccggacaccatattggaaaagctcgggcacaactagaaacgagggaacgaacaatggacgtgagggtacatgaattacagctgacgcgagcacgggccgagcagttaatggacaggcagcgaaaagccaatgcagtagccaatatgcagcgtcgacgtgctccggagcttgcataccttgaagaacgacgccgccagacaatcgatttcgcgacgttgacgattgcgggtctatctctgctgacggtggctgtcatcgtcggacgagtctatgccatgtggatgtatgcaatcgcatgcgtcggcgtggtcgtctgcggtttcgcgctcatcagtgccgtgctgttgctcttgcgcggtgctgtagtaaaccgtgctgtgattgaattgtcaaaagcggctgtacttgcacgttcacgggtcggcgatgatcccgatagggcgggacaatcccagaatgatgccgataccgtgcgagcgctgttcaccggacaggcggcaacggaacaggaagtggagccatgtaccaagaactacgccctcaacaggcggctcgagcagaacgagcgcgctgccttggagcagctgggccgacaagctgatgatgccgcacgggaatatcagtctgtggttggccaagtcgcgacattgcgcggtgacacggaatcctcgcatgcgcaggagcttgatcttgagcggcaaaataaactgtttgaagcgtttgtcaatgaacatggttggtgaagagctaaccagataattaattcggttggcaaccagcatccccgtcgcatccgcggcggggatttttcgtgcaaacgtgcgcatgatgcctgatggcatcgatcatatggtttccggatgcctgcaatgacgcgacatccgaatgcaatcggttgcggactccggtacggcaaaccatgtgtcatgcgtgcaatgcgcggcggggggacttcaaacacgcagggcaaagcgacgaaaatgcgtcggaggatgcacgcaatcggaaaacgtcatacactgatggagattccatgcaaacgtatgcatgcgctcattgtcgaagacctgtggaatccgcgcatggccgcgcgcaagatgcatacgtcaggaaagaggcgattgcatatgcgcagttgcattgcgtcgccactggattagaaggacaggaacgacatggttattcagcacatgcacaccgcgtttcgccggaccgcaggcatcggcgtggcattggccacgctgtgcgccgatgtggtgatcgcggcaccgaatgcggcgaatgcggcgccagccgacaccggcagtcccggctgccgaaggccacgggcatacagatgatcgcattccagcaaacatgaaataccatcgcggaagaatgcgggcgcacctatgggccctaggggattcggtatgtggaggtgtctcctccccaggaatcgatccgaggcacccagtggcggacctcctaccagccggtcagctatcggctcgattcgaaactcggcaccgaagccgagttcaaggccatggtggaacagtgcaatgcggcaggcgtcggcatcatcgccgacgtcgtgctcaaccagacgaccgggtcggacgtcgccgcaggtgagcaaacaggcgtcgtgggcaccagatacaacggtacgaccggcgactacccaggattcaccggcgagagcaaccggtaccccgacggcgtgaccgccgccgacttccacgactacgacaacggtgcgaacatctccgactacaagaaccagcaggaggtgcaggaaggccgtttgagctcgatgtgggacttcgacacgtcgagcgagaaggtgcggcagatccagtcggattacctgaccaaactctacaacatgggcgtacagggcttccgcatggatgaggtcaagcacgtcaacaacgaggatatgaaggccatcaaggactagatggccaggaagatcggcaagagtgccgacgacatctactggattcaggaggtcatcggcaacgcgaacgaggcgcccggcatccagccgcgcaactatcttggaacaggcaccgtcacacagttcgactacaagtcggacctcaacgccaaattcaaaggcaagatcgccggactcaaagacctttccatgcgcatcggcgacctatcgcaaaacccgaacgcggttgaatccaaggatgcgaacgtcttcgtgccgaactgggacaccgcccgcaacgacggcgcgatcacgtacaagaacggttcgatgtacgcgctcgcgaacgcgttcatgctcgcctacgactacggcacgccgcgtctgctctccgactataaacgaccttggcgcgacatacgaagagaatggcaccgccttcaaactgtgggctccgacggcacagaaggttgagctcgtcactttcaggtccgctgattccgcggacgctgaagaggccgctgtcgtggaaatgagacttggtgagaagggcgtgtggaacgctaccgaaaaggttccttccagcgccgcctacatctaccgtgtgtctttcgcggacggcacgacgaacgattccgcagacccgtatgcacgcgcatccgtagtcaatggacgccgttccgtcattctgtccaacgcagtgacgaccgtcaaggatttcaggcgaatggccccattcacgaaaaacaccgacgccggcattttcgaagcgcaccgcggcaagtatttcggcatgattaagcacgggacgaagaactccaaaggcaaagcgactggcgtcgactacctgaaggaactcggcgtcacgcatgtgcagatccagccgaatgcttacgagctcgacatccacaactccacggtcgcgttcttcaacgattcgattcgcgacggtctgaagggtttcgtgttctcaacggaagacaccggtttcgcaagcagcaagccgaacaccgagggtctgatcctgaacaacatgctcggctgccagaatccggaaggcatctcgaaaggctcattctgcacgaacggcaacgcgaacgtgaaatacggcaatgcagggcagatcgtcaactatgttgagatccatgacaatctgacgctcaacgacaagctcaatgtctcgctattcggcaagaagaccgacgatgagcttgacgcagcgcagaagaccgagaagatcacggtttcgaagcttgatgattcagcggtcttccttgctcatggcgtctccgaattccaggtgggccaggagatgctgcgcacgaagggcggcgacgagaacagctacaatgctggcgatgacaccaacaagctcgactgggatcgccccaacgacgccgagtacgcggacaacgcgcagtacatgcgcggtctgatcaagattcgtaagcgcaacgctgtgctccgtgtcggcgcctatggcacgatcaacaagaacgcgaaggtggtgtagtccgccgagggcctcgtcgcatacgaggtcaaggatgacaacggcgtgaactacgtggttgtgctcaaccacaatgatcagccaactgatctcaatggtgtcaccgcaggcaaatacggcgtgctggtctccaatggcaagacctatctgcatccagcagtctccgatacgacggcagctgcagctgttgccgcaccagcggataccggcaaggatgtctcgaaggcaggcagcactgtgcaaatcgcgggcggcgatgccatcgcggttcctgccaggagcgccctgctgctcggcccaaccgcggtgatgagtgagccggacaatccggataacccgaataatccggataacccagataattcggatcagcctgacaagccaagtggcgacaacgcacataatggcgccaacaatgcggccaatggtgcgaacaacgcgtcagcctcacatggcggtacggcgtccactggctcgtcgattgcagtcatcattgcgatggtcattgtgctgctcatcgccggctccggcatgttactcaggattcactctccccatgagcgaacattgaaccggcaagagacaagtgcctgaataggcgaaatacaagagggcgtgttcacaaggtgcgccctcttgttgatggagcgaggatgatgcaacgcagtgtcgagcaaagtccctttgtgcatgtcatgccggagcgataccatgaagacccatggttagaagacaacatggcaatgctcaagaacacgtcaccaagcatattttcgtcactggcggcgttgtttcctcccttggcaagggtcttaccgcttcctctctcggacgtctgctgcgcagccggggactgcgtgtgctgcagcagaaactcgacccgtacatcaatgtcgatcccggcaccatgaacccgttccagcatggcgaggtctatgtgaccgaggatggcgcggaaaccgatctcgacatcggccactacgagcgtttcctggacgtcttcctttcacagaaggcgaacgtcaccaccggccagatctatcaggaggtccttcgcaaggaacgcgctggtgagtacctcggccagtgcgtgcaggtgatcccgcatatcacgaacgagatcaaatcccgtatgcgtgcgcaggcctccgatgacgtcgacgtgatcatcaccgagatcggcggcacagtgggtgacatcgaatcgcagccgttcatggaggccgcacgtgaggtgcgtcgtgatctcggtcccgggaactgcatgttcatccatgtatcgcttgtgccctacatcgccgccgcccatgagctcaagacgaagccgacgcagcattccgtgatgatgctgcgacagctcggcatctcgccggatgcactcgtactgcgcagcgaccgtccgctcaaccagtccatcaaagacaagatctcgctcatgtgcgacgtcgactccgagggcgtggtgaactgtgtggacgccaacagcatctacgatgtgcctaaggtgctgttcgacgaaggtctcgacgcctatgtggtccgagagctcggcctgccgttccacgacgttgattgggacgagtgggaggaccttcttgaacgcgtgcaccaccccaagcatgaggtgaacatcgccatcgtcggcaagtacatcgaccttcccgatgcctatctttcggtcaccgaggccatcaaggcaggcggtttcgccaactgggccaaggtcaacgtgaaatgggtcgccgctgatctgtgcgagacggaggccggtgcggctgcggccctcaacaatgtcgacggcatcgtgattccgggcggcttcggcattcgtggcatcgacggcaagatcggcgccctgcgcttcgcacgcgagcacaagcttccggcacttggactgtgcctggggctgcagtcgatggtgatcgaatatgcccgtgacgtgctcgacatcaaggatgcgaattcctcggagttcgacccggagtgcgcgaatcccgtcattgccacgatggaggagcagaaggacatcgtcgccggcaatggcgacatgggccatacgatgcgtctgggctcctatccggcggaactgctcgaagattcgctggtcgccaagctctatgggaccacccatgtgactgaacgccatcgtcatcgttacgaagtgaacgtggcatacaaggatcgtctgcgcgagggcggtctggtcatctccggccagagccccgacggggagctcaccgaattcgtggaactgccgcaggatgtgcatccgttctatgtcgccacccaggcgcatccggagttcaaatcgcgcccgaccaagccgcacccgttgtttgccggtttggtgaaggctgcgttggaccatcaggaggcgcgtgacaccaagaaggccactgccgaatagggcttaggtgccgtcggtgaggcggctttgtgaagaatgcacgaaacatggtcatgaaccgcttgctgttcatgaccatgttgcataatatggacaggcccaattccttttgggatttctttggggagtgttttcaaggagcaatatgacttttccatccggcaatggtgggttctcttcgaacggagccagcaatcaggtgccatcggatgccagcgacatgcgtgatttcgagtcgacgcaggtgttcacgccgatgcaggatgtgccactgcctccacagctcccacagcagcacgattccaatgcaggcatgaatgggcctgccgcaggaaagaggcaccatgtatggccatggatcgtgctggcgctggtcgtcgtgctggcaggtgcctgtgccggtcttgtggcgttcttcaatacccgcgcgctgcctggcaccacgctctggggagttgacgtgtccggaaagacgcagcagcagattgcccaggccatttccaacgaggtggatggcaccaagattccggtcagctacgagggcaaaaccgggtcggtcacgctggcggacctcggcgtcaaggtcgatgcacagcaaatcgcccaggaggcagtggatgcgaaacgccatgagaacgtattcgcccgatatgcaccatgggcgaagcatgacgtgaacccggccatcgatgccaaggatgcgaatccggaagccctcgatgagcagctgggcaccaacagcgtcaaacccgtcgacgccaagctgcaggtgggcgatgatggcagcaccatcgcggtcatcgaaggcactgagggtcacggggccgatccgaccgagaccgccaacgaggcggtgcgtgtcgtgcagtccctgggagcgcaggaaccgaagaccgtggaggtgcagctcaagaccatctcgccggcgatcaccaccgatgaggcgaacaaggccaaatccacgttggacaaactgatggcacagaagccgggcgtgtacattggcaaggaacggttcgccgcattcacaccgtctatgatcctcgccgcgacgacgatcgacccgaacggcaacggcacgctgccgcaaggccagatccgcaacggcaacgtcgtctacgatgcgactgccctgcagaaggcatatgacgagcagatcaagccgaacatcaagtccaccaaggaagatcgcgaggtcatcgtcaacaacaacggcaccgagatcgaagtgatcaaggaaggccatgacggtgtgacactcgacgatggtgcagacgccaacatcggcaccaaggcgatcgatgcgtttggcaaggggaacgggaccgtgtccgtttccggcaaactcgacccgatgaaggtgaaggagacaaaacggcacgttgtggtcgatctctcggatcacaccgtgaccgctttggagaacggcaacgcggtgaagacgatgcatatgtccgcaggccaaggcaacgactatgccaccggcaaatgccaggcctcgggcgacatgtgcacgccggaaggtgatttcgagatctggctcaaatacccgtctcagaacatgtcgggcacattgacgctttcggacggcaagaaggagacgtgggacgtcaagaacgtcggcttcgtcaactatttctcgaagagcggctgcgccatccatcgcattgccacgcagaccccatacactgatgcgcagattcaggccctgggtgagaacacctcccacggttgcgtcggcatcggctgggacatggcggaatggttctacaactggtgcgtggatggcaccagcgtgcacgtccagcaataaggggcaacaaaactagaaggcccggcgagttctagaactcgccgggccttcgttatccgaatgcgtgccacatggggcggctgccatcgtcgtcgagtcttgcggacgtgatgaacattacgggagaaaagtgatgaaaaacctagatttttgtcattccttctgttaggttaggacaggaacgaatttgataggaggcagcgcaagtggcagataaccaggcgccccatgccgcacgggatgtggagatgaatcagtacatcgccgatcgcggtcgcgtcaatgaagacaagctgcgacaggacgacgagatcatcgagcagttcggcgaatacggctacggatggcatgattccgacgccgcaggagaagcggcgaaaaaaggcatcgatgagaacgtggtccgtgagatctcggcggacaagcacgaacctgagtggatgctcgacatgcgtctgcgcggttaccgggcgttcatagagcaaccgatgccgaaatggggtgtggatctttcgggattccacgcgcaggatttcaagtactatgtcaagcccgtcggcaagcaggctgcaagctgggaggatctccctgaggatatccgaaccacctacgacaggctgggcatacccgaagccgagaagagccgcctggtttccggtgttgcggcccagtacgaatccgaggtcatctacaactccattcaggatgatctttccaagcagggcgtcatcttcgtcgataccgacacagccgtacgtgagtacccggagctggtgcagaaatacttcggaacggtcgtcccccctgaagacaacaaattcggggccctgaacacggcggcatggtcgggcggctcgttcgtgtatgtgcccaagggcgtgcatgtggacattccgttgcaggcctacttccgcatcaacaccccgaacatgggacagttcgaacgcacgctgatcatagccgacgaaggttcatacgtgcattatgtggaggggtgcacggcgccgatctactcgaccgactcgctgcacgccgcgatcgtcgagatcatcgtggagaagaacgcccgcgtccggtacaccaccgtgcagaactggtcgaacaacgtgtacaatctcgtcacgcaacgcgcctatgtgcgcgagggcgccacaatggaatgggtcgacggcaacatcggctcgaaggccaccatgaaataccccgcctgcatccttgccgaaccctacgccagcgcctccacgatgtcgctgggtttcgcaggcaaggggcagtaccaggacaccggtgcgaagatgattcacttggccccccatacctcttccaccatcgtcgcgaagtccatatcgcgaggaggtgggcgttccgcctatcgaggacttgtcaagatcgtcgacggcgccgaagggtcgagctccaatgtggtgtgtgatgcgctgttggtcgatgacttctcacgctccgacacctacccccatgtggatgtgcgcgaggacgacgtttcgatggcccatgaggccaccgtgtcgaaggtctcggaggaccagctcttctacctgatgagccgcggcattgaggagaaggaggccatggcgatgatcgtgcgtggattcgtcgagccaatcagccgcgagctgcccatggaatacgcgctcgaactcaaccgtttggttgaattgcagatggaaggatcggtgggctgacctatggcagacccaaaggaaatcaacatcccggtggcggatccaaatgacccgtatgcgattcccgccgccatgccgtcgagtgccgacacggcgccacgctcattcgaggtggagacgttcccagtgcccacgcgcaagcaggaggattggcgattcacacccgtcgaccgcctcagtgaattcttcgatgtgttcgaacccagcggccgaacgcaggtgagcgtgacgatgatcgatggctccgcagtggacgggtccaaggtcgatgtgcgcacggtgaacatgggcgaagacctgagcggaaccgtgagtatgccgaatgaccgtgtctcctgcgtcgaatggaacagtgccagggaatccacaatcatcgaactcaagcaggatctcgagcatcccgtgctggtcaaggtgttcggaaccgatgacgctctggatgccctgcatctggtcatcgcagccgacgctcgcgtccatgccgatgtcgtcgtcgagcactatggcaatgccagactcgccgaaggcgtggagatcgtcaccggcgaggactcccacatcagcacgaccttcattcaggaatgggatcgtggctccaagcatgtgggcaaccatcgcatccatgtgggcaaggaggcatcgctgcgtcattcgcaggtcacgctcggtggcgacgtggtacgcatccgcatggatcaggatttcggcggcgagcatggcgagctcaacatgctcggcatttacttcgtcgatccgggcgagcatatcgaacatcgtacgatggtcgtgcacaacgaacccgaatgcaagtcccgtgtggtctacaagggtgcgctgagcggcaagggcgcccattccacatgggtaggcaatgcactgatccagcccaccgcaccgggaaccgactcctacgaactcaaccgcaatctggtgctcacgccgggagccgttgccgactccgaaccgaatctggagatcgagaacggcaacatagtgggcgcggggcatgccagctcggtcggccgtttcgacgacgaggaactgttctacctggaatcgcgcggcatccccgagaaagaggctcgaaagctcgtggtgcgcggtttcttcggtgagctcgtcgaggagatcggcatcgatgagatcgccacgcatctcatgcaggccatcgaccgtcgcctggtgcgcggtgagaacgaagcaatgacgaacgttttggaggagaagtaatgtcgacgttggaaatcagggatctctacgcatcggtggagacgaaggaaggccgcaagcagattctgcgcggtgtcaatctcacggtgaactccggcgagacccatgcgatcatgggaccgaacggttcgggaaagtcgacgctggcctacactctggcaggccacccgaaatacgaggtggattcgggtgaggtgctgctggacggcgaggacattctcaagatgacgccggatgagcgcgccaaggcgggcctgttcctggcgatgcagtacccggtcgaggttcccggcgtctccatgacgaacttcctgcgcaccgccgtcaccgaggtcaccggcaaggcgccggcgatccgtacgtgggcgaaggagctttccagcgcgatgaaggacctcaagatggatccgaaattcgcttcgcgctccgtcaacgaagggttctccgggggtgaaaagaagcgggccgaggtattgcagctcgagatgctcaagccgaagttcgctattctcgacgagacggattctggacttgacgtcgatgcgctgcgcgtcgtgtctgaaggagtgaatcatgccaaggagagcaacgacttcggcatcctcatggtcacccattacacgcgtattctcaagtacatcaagcccgacgtcgtgcatgtgttcgcacagggtcacttcgtgaagacgggaggcccggagttggccgacgagctggaggagaccggttacgacatgtacctgccggaaggttcagattccgaatccgctttggcatgaatgacccatgactattcgtaaggtgttgtgatgacggatatcactgcgattcgcgatcaattccccattctcgaccagcagatcaatggccatccgctggtgtatctcgacagtggcgccacagcgcagaagccgcagtgtgtcattgacgccgaatctcgtttctacgagacggtcaacgccggcgtgcatcgcggagcccataccttggccggtctgtccaccgtcgccttcgaacaggcccgtgccaaggtggccacactcgtgggcgcctcagctgaggaaggcaacgaggagcttgtggtgaccatgggcgccaccgacggcctcaacacgctggccacggcgttcggcaacgcctcattggggcgtggtggcaaggtcgctgagcgtttcgccttgaaaccgggcgacgagatcgtcgtctcccgcgcggaacaccattccgtactgctgccattccaagaacttgcctcgcgcaccggcgccaccctcaaatggttcgatctggatgacgacggtcgcatcctctccaacaccgcagacgaggtcatcacggaacggaccaaggtggtggccgtgacccatgtgggcaatgtcaccggtgccataaccgatattgccccgattatcaaacgaacccatgaggtcggaggcgtcttcattctggacgcgtgccaatcggttccacacattccggtcgacttccatgcgttggacgtggatttcgcggtgttcagtgcccacaagatgtacggtcccactggcgtgggcttcctgtacggcaagcgcgatttgttggaggcattgcctccggccaagttcggcggttccatggtcgagctggccttcgtggacaggcctgcccagtacatggcgcctccggcacggttcgaggccgggacgcagccggtggcccaagtggtcgcagcgggtgtggcggcggaatggatgatgggcatcggcatagagacgattgccggccatgaacgcatcatcaccgaagaactgctccggcttgccgaagtcgatggagttcgcattctgggcccccaggacggaacgaaccgcatcggcacggtggcctttgaagtggatggggtgcatccgcacgatgtggggcagtacatcgacgcccaaggtatcgcgatacgtgtaggacatcattgcgcccagcccatccacaggcatttcggtgtattcgcttcgaaccgcgcgtcttcaggcatatacaacacacccgaggatgcacaggcgttggttgaggcggtggaaggtgtgcgccggttcttcctgcagtgaaggcgtaggtgtcttccgtctatctgaccggcggggaatagtcccgaacgatatatgttgcttgtgtaggaatgaaggaaaggagcgggatggcagatttgggaagccaggaactcgagcagatgtaccaggaagtgattctcgatgcctcgcgtcatccacatggcaggggcacactgacatcggagggcgatcccgcggcaatcggaggcgaggcgacagtcaccgctgtgcatgagtcctgctccgcagcacggtcgcaccaattcaatccgacctgcggcgatgaggtcactgtgcatgtcgaagtgagcgatagtgaaccccaccgcatcgaaagtgtcgtctgggatggtcaaggatgctcgatttcacaggcaagcctgtcgatcatggtcaatctcgtggaaggaaagaccgtcgatgaggccatggagctgttcggccagttccataagctgatggaatcgcgaggcgccggtctcgatgacgaacaggcagaggatgcgttgggtgatgccgccgtattccaaggggtttccaaatacccgatgcgcatcaaatgcgcattgctcggctgggaggggctcagggactcattggcgaaggccctcgcatcccagcactccgaggcaaccgagcatgacgagatgaaggaggactgatatgagcgacaatctggttcccgaaccgcaatccaccatcttcgatgcggtcaatgccgtcgtcggcaatgaggatgaggcccaggcgatcattgcgaatccatcgttggcgaaggacattctgggcaacgacgacgcatctgccgtcaagtcggagtgctgtggcggccatggcgtccagtcgcaagaccatgaatgcgcatgccgatcggatggcatcgagcttaaaggtgtcgatgagatcggccgtgccactgcggcggatgtgaaggaggccctgcatcaggtgatcgatccggaactgggcatcgatgtgatcgatctgggtttggtctacggcattgagatcgatgagctcggccgcgcgatcatcacgatgacgctgacgacgcctgcatgcccattgaccgacctgattgaagacgaatgcgccagcaccttggccggcttggtagaggagttccgcatcgactggacttggacacctcgttggaccgtcgacaagatcacgccggaaggccgtgaccagcttgcggcattgggcttcaacctcgacaatatgccacgatactgagttgtggtatgtggaaggggccgcctccaatatattggaggcggccccttccacataccacaactcgtcacaggcggctagtcgtcgaccaccgttcccttcggcaccacggtgatgccgtcggaggtcacggtgaagccacgtgccaagtcgtgttcgacgtcaagaccaacagtcgaattctcggtgagcaccacattcttgtcgagaatggcacggttcacacgggccctgcggttgatctccacattgtcgaacaggatcgaatcattgacctgcgaccaggaatgcactcgtacattcggtgagatcactgaatggtgaatctcgccacccgatacgatgacgccaggggagacgatggaatcggtggcgtgtccgatgcggtcgccggccgcatgcacgaacttggccggcggaagattgcccgaactcgtataaatcggccattccatattgtaaaggttgaattcggggatgtaggagatgagatccatatgcgcatcgtagaactgcctgattgtgcccacgtcgcgccagtaggcatgatccgtggtggtggcccctggaatctcgttcctgctgaagtcgtagacgccggcctcgttgcgttcggcgaagaacggggcgatgtcgccacccatatcgtgtttcgtgttctcggccttgctgtcgatggagagcgcgttgaacaacgcgtcggtgttcgcaacataattgcccatggaggcgaggatctcattcgggttgtctggcagccccgtcgtctccttcggcttctcttggaagcttttgatcatattcgggtgctcgggatccacctcgatcacaccgaactggctggactgctcgatcggctggcgaatgccggccacagtgaactcggcgcccgattcgatgtgctggttcaccatctgctcgaagtccatgcgatagacgtgatcagccccgacaatcaccacgatgtcaggttggacatcttcgatgatgttgatcgtctggtacacggcgtccgctgaccccagataccagtgcttgccgagccgctgctgtgcggggacgggggagacatagttgcccagcaatgtggagaagcgccacagctgcgagatatggcggtcaagtgagtgcgacttgtactgggtgagcacaatcacctggctatacccggaattcaccagattgctcaacgggaaatcgatgagtcggtatacgccaccaaatgggacggcgggcttcgcgcgatccctggtcaacggcatgagacgtgttccttcgccgcctgcgaggacgatggaaagaatcttggggttcttcttcgccatagcagctccttcctacggatccacagaacctaatctgttcagcattcatcattgaagacacctcaataattgcatagattcgctgtgaggtaaaaccgaatcgcccaaaacgccgtcgtttttgcaagaaaagctggcatataggtcaaaatgtgttgattatgctgtgggtttgccgttgtggcagtaggcgtgtcggggtgtcattttcggttttcccgtaaataaccgcgtttcgcgccggttcggggccgttggattgtgtcatgagaacacgatcgaagcgggcccgcagatatccgatctgctggctgccgatgcgcaagaacgggcacgaccgaaacggccggcagcgttggcagtgcgacgcctgcaaggcgacgacgaccgcctctgccgaggcaagggggcgcgcggcagtggtgcgcccgggagagcacgagcgctggaagggcatgctcgccgaacgcacgtacgccaaggaccatcccgacgatcccaaggccgccacgagcaggagcggatggtggtggacccatttaccgttacgccgcgcctatttcaggcttgaacgcctcttcaacgacggcacgctcttctgtctcttcgaccccacactgagcgcacacagccccgtgccacgcgacagcgaccgcctcgagggagggctcaacgccgcgctcaaacgcatgctcgtcaaccaccgcggcctgcccgaggcacacatgcgccgcgcctgcgaatggcactgctatatgcatagcgccaaacccgatcccgcccacatcctcaaacaacacgaccagaacactaagaccggcaccaaccacgacaacaacgacgaacccatgagccaacccaccctcggcaccggcatcgactggaacgaattccacaccgccacccgatacccagacaccaccgactaaaagtctaaatcaacacattttgacctatatgccgaaagctcaaaatgtttcataatatggaaccgttttcggaggatgtgtcccacgctccgaatcagcgggcatgcttcagatcgcgcgtgctataaaatgcgacggcgctcgatgcggcgacgttgagggagtccacgtcatggctcatgggaatcttcacggtgagatcggcattcgcgatcgtatgtcgtgacagtccgtcgccttccgtgccgaagatcagtgccagcttgtcgatatgcgtgttgtcgttggcgtggagacgccacacgaggtcgtcaagcgagattgagtcatcggatagcgccatcgccgcggtggtgaagccgagcccatgcagttcctccagaccctgccatggccagtagtgcacgtcatcgccccctatgcgcgtccatggcacttggaaaacagtgcccatcgacacacggatggcgcggcgatacagggggtctgagcatgagggcgtgaccagcaccgcatcgacatccaacgccgctgccgaacgcatgatggctccgacgttggtgtggtccactatgttctccagcacggcgatgcgcgtggcattcgcacatacctccgccacagtgggaagctcccaacgatgcatggcagccaacgccccgcggtgcagccggtagccggtgatgcgcctgagctgttcgggagaggcgacgtagacgggaatgtcgtcgccccagtgttcatcgatgaacgcgaagatgtcggccatgccctcgatccatggttcctccaccagcaaggaaatcggttggcgtcctgcggccaatgcgcgcgtgatcaccttgggtgattccgctatgaatatgcctttgcttggttcaagccgattgcgtagctgaagttcggtgagattcgtgtatgcctccacctgagggtcatcgatggactcgagatgcaccagctgcatgattgcctttccgaatggggaaataaaaaaccggctcccaaaggagccggtagctggtgtccggagcgggacttgaacccgcacgcctgtataaaataggcactagcacctcaagctagcgcgtctaccattccgccacccggacaggtgcgttgcagcgcaacagaaagaaaatatacgcgaatatacggatcaatgcaaattcggcgtgtcgtgttttgaggccgacgccaaggggttggaattcaagggaaaacggttacccatatgcgctagggtacaactatgaccgacgcaatgtttgtggtggatacgaccagtgacgatgctccgctgagcagtgatgaactgcagacagggtggaccctgcgattgcccgaggaggtgaggcgacatgccatcggctccatgcgcctgaaggaaggcgatgagctgcagctttccgacggcacggggttgcgcattcaggctgtggtggacgatcccaagtcgggcatcgtcagggtgctcggattcaccaaggaggaacgccctgtggtcagattgggcctcattcaggctctggccaagaatgggcacgatgagcaggcgatcgatatggccacgcagattggggtggacgaggtgacaccctggcaggcggaccgttccatcgcaagattcaaagcggggcgcaccgatcgcaaatggatgcagacgctgcgtgcggccaccgagcaatctcggcgcgcattcattcccgaactgcacggcatggcaacaagcaagcaggttcttgccatgattcggcgtgacatggtgcatggcaatctggtcatcgtgctccatcaggacgcgaacgccacatggtcggacgtcgaacgccaggttgaggagcttgctgcgaaatgcctggatgacggcaaggaacggacggtcagcgtggttgtgggtcctgaaggcggcatcagcgatcaggaggtcgaagtcttcgccgaggcgggcgcgttggtctgcgtgctggggcgcaacatcctgcgcgcctcggctgcaggccccgtggcgcttgggctgctgagccgtgcgataggcaggtactgttgagcggacgacgcgttccttcatggaatgaatatgcgcgcggattggtagtatgggcagaggaaaaatccatcacgccaaggagtgagacggtatgaaagacgcggattgcctgttctgcaagatcattgactgcgaggtgccgagtgagaaggtgttcgaagatgcgcaggtgtatgcgttcaaagacatcaatccaaaggccaaggtgcatgtgctggtggtgcctcgcgaccattaccgcaacgtcgacgcattggcgcaggccgacccggcattgttggcgcatatggtcgaagtggcccagggcattgccgatgacgcatataacggctcgtaccgcctgatcttcaacaccggagaggacgccgggcagacggtgttccacgtgcatgcgcatgtgctcaccggcgagcccatggaagaatgacacgatatctctccaagacaccacagacgtatagaacatgtagaagaggagcagttggcgactacaacacgaacggtcgatattcccgaacagctggattccgtgaaagtactcggagtgtacgatgaggtgattcgcgagatcgaacgcgaatacaaggagattaccgtgcatgtgcgcggcaatcgcatcaccatcacctccacctcgcggcaaggcgagcgcgaggcgtcgcaggcgcaggagctcattcgcgcactcatcgatgcggcttacaccagtccgctcgacgcagccacggttcgccgtatgctggaacagcaggtgttgcataacgatgtacgcgacgaggtgcccggccatggtccgaccgtgcagaagctgcgcaggttcaaggagcatgagcgcacgcaggcgcgacagattgagtccgttcatcgcaagccgagtgtgccagggaccatcacctatgccgccgggtatccggtgcggccgaagacctccggtcagatcgcctatgtgaacgccatagagtcgaatacaatcacattcggcattggccctgctggtaccggcaagacatatctggccgtggccaaggccgtaagcgacttcgaggaggggcgtgtcaggcgcatcatcctcacccgtcccgccgtcgaggcgggggagaacctcggcttcctgccgggcacgctcaacgagaaggtggatccatatctgcggccgctgtacgacgcgctctccgacatgctcggtgctgaacggatgaagcggtatctcgacgacgggaccattgaggtggctccgctggcgtatatgcgtggccgaacgctgaatgatgcgttcgtgattctcgacgaggcgcagaacacgacgagtcagcagatgaagatgttcctcaccagactcgggttcaacacgaagatggtgatcaccggcgatatcacacaggtcgacctcgatgtgccgcgttccgggcttgcctcgatcgaatcgattctcgggggcatagacgacatcgcgttcgtgcatctgggggcttcggacgtggtgcgtcatgcgttggtgggcaggattgtggccgcatacgagtcgcatgatgacgcggcacggaggcgcaaaggcggcaaagatgcgagaataacgcacacggcggcacctggtcgcggtgacgatgatgacaggaatgcgatggtggtggacgatgagcgttgaagtcgccaatgagacggaatggcagttggatcccaaagtgttctcggaactcggcctgtgggtcatgcaccagatgcgggtgagcacgcagtccgagctcaccatcaccttcgtggacccggaaccgatcgcagagctgcatgaacgttggatggaccttcaggggccaaccgacgtgatgagcttcccgatggatgaactgcgcccgggggacgagcggaacgaaccagaggggatgctcggcgacatcgtgatctgcccgtgggtggcgcagcaacaggctcaggcggccggtcacagcacgatggaggagatgatgctgctcaccattcatggtgtgctgcacctgctggggtatgaccatcacacacgggagcaggaacggcagatgttcgggctgcagcgccagctgctgctcacgttcttcgcattgcaccatggcacagcctggtcggcgacgcttccctccggatcggtgaacgaactcgaggtgtacgaacgcaaatacggcacgaaccgtgagcttggacactgaacgtagggggcattgaagtggacgaactgagaatcgtcacggtggtggcgctggttgtcgtggccatcgtactgttctggcaatcactgctcatggcgtcgcttgaaagcgccattgtgcgggtgaccagggcgaatctgaacaacctgatgatcgaggcgcagaccgattccgaattgagccagttcacccggcagaagaagatcgcgaagatccatcgcgtgcagcatctcgttgcaaaccggcatgccacgtcttcggcctgcgcttttctgcgtattctgagcaatgtgctcatcggggcctgtgtggtatgcattgcggccatattcgccagtccggtatggctgcaactcatctatggcgtgcttgccgctctggtggtcgcgttcgtgtcggtgttggccagaccgcgttccgtgggttccgacaagccgctggagattttgctggcatactcccatttggcctcatttgcctatgcctgtgcgccgttcctgcacccgcgcaagtcgaagagcgcgcgcaagaccgagctctcggagaacgaggagctcgaggagattcatcttgagcaggggcgcgccgccatcaatcgtgtgctggagacgaaccggttcgacccagaggtctccgaaatgctgcacaatgtgctggcgctatccgattccctcacgcgcgagatcatggtgcctcgcaccgacatgatctgcattgaaaaggacgacacgctggaggacttcctcaaactgtgctcgcgttccggctattcgcgcattccggtgattggcaatgacatagacgacctgctcggcatcgcatacatgaaggatgccgtgcgtgcgacgatcttcaacaatgccgcgttgagccggcccatcgaatcgattatgcgcaagcccatgctcgtgcccgagctgaagccggccgacgatctgttccatgagatgcagcagacctgccaccatgttgccgtcgtcgtcgatgagtacggcggtatcgcgggcatggtcaccatagaggatgcgctcgagcagatcgtgggggagctgcaggacgagcatgatcacacccagcatggcgagccgcgtcagataggcgaacataagtggagcatgccggcgcgcactccgattgccgaattggaagacatcttcgagatcgatctcgacgaagatgacgtggataccgtgtacggattgctcaccaaactgctgggacgtgtgccgatcgtggggtcgagtgccgtcacgcgcggtctgcgtctcaccgcagtggattccgcggggcgccgcaagaaagcctccaccattgttgtcgaaccggagtccgatgtcgatcagactaccttggaatccgacgctgattccccggactcgaactccaccaagaaagaacaggattgatatggctgaccagacacataccaagggggtcgacgctgtttccggcgtcactccttaccgttccggcttcgttgccgtcgtgggacgcccgaatgtcggcaaatcgacgctgatcaacgcgctcatcggcatgcagatcgccattgcgtcatcacggccggagacgacccgcaaggcgattcgcggcgtgctcaccaccgacaacgcccagatcgtgctcgtcgacacgccgggcatacacaggccccgcacgctgcttggccaacgtctcaacgatgtggtggacgaatcattggcggacagcgacgaaatcgcattcctgctgccggcggatcaggagatcggtcccggtgaccggcgcatcctgagcagactgcgttcccagttcgccacgaagaacgatgacggtaccttcaaatggaaggtgccgcttatcgccatcgtgacgaagatcgaccgtctgaaccgcaccgaactcgtcaacaagctcatcgagatcaatgaattcgcggatttcgccgacatcgtgccggtgagtgcgctcggggacgacaatctgcaggaggtgcgcacggtgctcatcgagcatctgccggaggggccgcagatgtacccgacggatcaggtgaccgaggaacgcccggaggatgccatcgccgagctggtgcgcggggtgctgctcgaggagctcgacgatgaattgccccattccctcgccgtcgtggtcgattccatcgacatgccggaagacatggatgaggacgatgcgcaggccatgcatggcaaagcacgtgtgatggtgtccatctacgtggaacgcgattcgcagaagccgatcatcatcggcaggcacgccgagcatcttgtgcgcatcaagaagcgattgcgcacccccgtcaatcgtcttgtgggacgcaaggcgaatcttgacctccatgtcaaggtggcgaagaactggcagtccgaccccaagaaactcgacagattgggcttctaatccattgatatgggaaggctcccgtcatatgacatatgacgggagccttcccatatcaatggatgcagcggtatcagcctcgttgagaatcctcggaagcgggcttgcgcttggtgtacatctgcgtgttgagcagcgtgttgtagcgcttgagcaccttcgggcgaatgatcttcatggaggcggtcatcaggccgttctcctgcgtgaattcctcgggaagaatgatgaacttgcgcaccgattccgcccgggagacgccttcgttggcctgatcgacccacttctgcacttccgcgcgcacggcggcgttctgtgcggcgtcctccatggtcatgcccgaatcgaggccctgcttggcaagccatgggcgcagcgagtcctcatccaaggtgatgagcgcggagatgaacggacgcttatcaccgagcaccaacgcctgggaaacgaacgggcagcgcttgatcacttcctccatggggcccggagagacgttcttgccgccggcggtgatgataaggtccttcttgcgtccgatgatgaacaggaagccgtcgtcatcgagccgcccaagatcgccggtgcgataccagccatcgtcggtgaagctcagctcggtttcctcctcgttcttgtgatagcgcttgaacaccgggacgcccttgacctgaatctcgttgccgtctccgatgcgcacctggaagcccgggaacgggatgccaaccgaaccttggtggtatggcacagtcagcgggttgaaggcgcaaggggcggtggtttcggtaagtccgtatccctcgtacacgggaatgccggcgccgcggaagaacgccatgagatcggggtcgagcggtgcgccgccggtcacaatccattttgcgcagccgccgagggcgtcgcgaatcgaagagtagaccatcgggtcgaacatgttgcgtcgtgcggtgacgaagcggctcgccttgcccttctcgctcacctcctgcatgtacttctgagcggcgaccaccgaggcggcaaagacgcggcccttcgggccgttgccggccttctgcgaggcggcgttgtagaccttctcgagcacacgcggcaccacgatcatgatgtgcggacgtgccactttgaggtcggcggtcagggtcttgatgccacgggcgatatagatatggatgtcactggcgacgcagatgtagttgatggcacgggcgaacgaatgtgcctgcggcaggaacaggagcacgcggttgcgcttgttatgcagcaaatcgggcatataatccggcaggttcgtggcggtggagcagtaatgggcctgcgtcatctcgacgcccttcggcgcagccgtggagcccgaggtgtacacgatggaacacagatcggtcttcttcacgctgcgaatgcgctcgtcgagcttctcgtcggagatggacgagccgtaggccttcaactcatcgagcgccccgttctccaggcacatgacgtccttgagcgtcgggcagtcctccttcgccagatccgtcttcttcatcatgtccttggtttcgaccacaaggagcttcgcgtcggaattgtcgacgatgttgcggatctgctcggcggaatcggtgtcgtagatcgtggcgatcacaccgccgatggagagcaccgcgccatcgaagacatcccattcataggaggtgtggcacatgaacgccaccccgtcgcccttcctgagcccctgatgcatgaggcccttggccacctgacggatgtcgtccaaggtctcgcgtgcagtcttggtgacccattcatcgccctgcttgaacgtgtacagaccctcgtcaggcatacgttcggcacggctttcatagatgttgtagatgctgaagttctccggtaatggcttgttgccttcggtgttggccgtgatgaaatcagagtcggcatcgatgaacgtggtggtcggcctgtccggaccccagaagtcgacatgtggcaggtcctcgtagttatgatgctgtggagtgatctgcggatcgatatagtccggggtgtcgccattggcgttgatcgggtgcgagaaatcaccacccaattgcagcagcttctgcgtcgcatcggacgcagacttcttgaccttcgagaaaacggacatggcactcctcatcgtttgataaaaccttctacgcgaagtctagccgtaaaatcgtccgccgtcaccttacgctttcgtaatgatgacttctggcgtaattagtcacgccttggacgaatgagggggagtcggtggccctgctgtggtagagcggtcggcaaaagtattcgatacatggacttttccatggtgttacatgcatgtttcgttagactgggcgctgtatgttcaccattcccatccggggatgcatagaaagggttcatatggctcaaacaccagaagccaacgtggtcttcggcgttttcaatgagacgtcagaccatgaatcccgcgtcgcgttgacgccggataccgtgacccgcctgcgcaaggcgggggtcacatgcatgattgagcagggcgccgggaacgcagccgcctacaccgacgaggattacgccaaggtcggcgccaccgtttgcactgccgacgatatactcgccaaggccgatgccctcggcttcgtcgatcggccatccgagcagatgatcggtcgcatcaagccgggcacctgggtcataggcatgctgagctcattcaccgacgaggactatgtggcggcgctggcaagcgccggcataaccgccgtcgccatcgaacgtctgccacgccagctcagctcagcccagtcgatggacgagatgacctcgcagaattcggtgatgggctacaaggcggtgctggtggccgccaacgcctacggttccttcctgccgatgatgaccacggctgcaggcaccatccgtccggctaagatgctcattctcggcgccggaatcgccggcctgcaggccattggcaccgccagaagactcggtgccgtggtgacggcgtacgatgttcgtcccgcctcgaagtccgaggtggaatcgcttggtgccaagttcctcgacctcggtatcgacctgtcccgtggacagggcgagggcggttacgcccgtgcgttgagtgccgaggagcaggcgcagcagcaggcggccgtggaccgaaaggccgcggaattcgacatcatcatcaccaccgccaaggttcccggccgtaaaccccccatgctgctcaccaaggccggtgtgggtggtctgcaccgcggcagtgtcattgtcgattgcgcggccagcgagctgggcggcaacgtggagggctcgcaaataggaacgcaggtgactgacggcggtgtgaccgtcatcggcgccccgtatctggccagcgaggtgagcaccaccgcctccaatctgctcagccgcaacgtggcggatgtcctcgcccacttcctggtgaacggcagactcgaagtgaggcagggcgaagagctcgacgatgcgatggtggtcgcccacacgcatgccgacagcaacgacgacaagaagaaaggggagtgacgatgccagatctggtcgtatcgatcaccctgttcatcctcgcactgatcattggcatagaggtcatcggaaaagtgccggcgacgctgcacacgccattgatgtcaggtgcgaactccatccacggcatcgtcatcgtcggtgtcgtcatcgtggccgccgaggccaacaactggctctcctatgtgttcatcttcctcgcggcggtgctgggaacaatgaacgtcgtgggtggctatgtggtcaccgaccgcatgctcgagatgttcaagagtaacaaagatgacgccaaggggaagggaggcgacaagtaatgaacaccacgccaatcgatattatcgcatggttcgcatacctgctgtccgccgtgatgttcgtcatgggtcttcattacatgaattccccgaagacggcgcgtaagggcaacttcatctcggcggccggcatggtggtcgccgtggtcatggccttcgtcaaactgttcatcaccggattcgagaatgcaatcgccatctggctgctgatcgcaggcatcatcataggtgccgtcgccggcgtcgcctcggcgaagagggtcaagatgaccgacatgccgcagctcgtctccgtgttcaacaccgtgggcggcggtgcggcggcccttgtcgcgctcaatgacatcctcgccggggagggcactccgagcatcgtcgtgctcatcaccgctggtctgggcgtcatgatcggttcggtaaccttcaccggttcgcttatcgccgccggcaagctgcagggcgtcaaatgggtgaggaacctctcgctgcccggcaagagcttttggaacatcctgttcatcgtgctcatggtcgcctcattcgtgctgttgtgcgtgttcccgcagcagcgcctcctgtgggcgatcctcaccaccgtgttcgccttgtgctacggcctggtgttcgtcattccgatcggcggtgccgacatgccggtggtcatctcggtgctcaatgcgtgcaccggcactgccgtcgcaatgtccggcttggccattgacaatgtggcgctcatcatcgctggcgccctcgtcggttctgccggcgtgacgctctccgtgctcatgtcgaaggccatgaaccgtccgctcatgtcggtgcttgccggcggcttcggcggttccaatgcatccgccggtgatggcgaggggccggaaggcacgatgaaggaaacgtcggcagacgatctcgcggtgcagctcgtctatgccgacaaggtcatcttcgtacctggattcggtctggcgcaggcgcaggcgcagcgtgaactcgccgatctgggcgaactgctcaaggagcatggcgttgaggtcgaatatgcgatccatccagtggccggtcgtatgcccggtcatatgaacgtgctcctcgcagaggcgaacgtgccctacgacgagctcgtcgatctcgacgacatcaatccgcagttcccggccgccaatgtctcattggtcgtcggcgcgaacgatgtgacgaacccggccgcacgcagacccggtacgccggtctcgggcatgcccatcctcgacgtcgacaagtcgcagaacgtcgtcgtgatgaagcgtggccgtggcaagggctacgccggcatcgagaacgagctgtactacgaagacaacacgcagatgctgttcggcgatgccaagcagagcctgcagtccgtcatcgcggctgtcaaggagctgctcggctgagtccgcggccatttccatggattgaagtattgaatagatggatgggggcagggtcccgctgtggcgggaccctgcccccatccatcgctattggggatggaatcggcgatcagtctgccatgtgcaggcagcggcgtaggaaggcgtccaccgtgctccaatacagattcctatcggtggtcaggccgagtatatgacctgcgccatgcacctgcaatctcgccttcacggggctggcgcatgcggtatatagtctgcccagcatatgcgggctgacgatgtcgtcctggtccccttgaatgaacagtatcggcaacgtggtgcgatgcagctgttcgatcgcattcgcctgacggaatccgaagccgagactgagcctgttcaccagactggcgcaatccaccatcggcttggccatccatttgggcaggtgaagcattgcggagaccgaatcgagcatctggtcgtattcgctagagaacccactgtcgacgacggcgcacaccacgttgcgagccagacgcgggtcggcacagacgtcgagtatcgtggcggcgcccatcgaattgccatgcagcagtatgcgggcgtcagggtcacgggccacaatcgagttgacccagcgcagcaggtcctcacgctccagccagcccatgccgacgaagcggccctcgctcagttcatgggcacgttgcgccggcaccagcaccctcatgccgagattggcgtaatggtatgcccaaggtgccatctcctcgggacctccggtgtagccatgcatgcaaatggcatgggtatggggcagtggcgcggccgtgttcgcatcgaaacgccatgcatgcagttttagcccgtcatagctgcgtatctgctcggcatgtctggtctgttcgaaccacagctgcgcctgcgtatcctccgctgcccgatgcgccgggtcgtgctgggcgaaagcgctgcgtgacttgttgcggaacaacgaacggttggattgcgaatcgaaggtgacggaaaagatcgtctccccggcggcgaggatcatgccacaggccagcatcgttccggctgcggctcccatatatggccatgcgctcgatattcgtttcgtcatgtctgcctccacacccgcaagtcgttccgttgtcataccggagccgcggcgttctgattgcatggtactgcataacgaatatatatggtattgctctccgtcatgtcgcggcctgccggtagtgttgaggagttgctttggcgagggaggccggtcggcctccgtcatcgactcggcaaaaagtgggctccttggggccgctttggctcgttgatgcgtcaagtggaaacaaggaggaatgcaacatggctaacaatagcattgttctcgaaggcgaactgcgcaccgagtttggcaagggccctgcccgccgcatgcgcgttgccaaggagatcccggcgaccatctacgcaggtggcgaccagccggtgtatgtgaagctgccgatgcgtgagacgtcgctggccctgcgccacaccaacgcactgttcaccatcaagttcggcgccgactccaagctcgctgtcgtcaaggatgtgcagcgcaacccggtcaagcgcatcatcgagcacatcgacttctatgaggtcaaggccggcgagaagatcgaagtcgaggttccggtcttcgtcgaaggcaccccgaagggtggcgccatcgcagtggttgatgcgcaggagctcaaggtccgcgcagatgtctccaacctcccggagcgcatcgtcgtctccgtcgagggcctgcaggatggcgacaacatcttcgccagggatctcgagctgccggagggtgtcgagctcgatatcgccgatccggaggaatccgtggtcaccatcgagatcccgcaggaggatcctgccgatttcgagaccgctgagccggcagatgccgttccggcggaagatgagaaggacgcaggcgcagaggcctgagccgttcgcgaatccgtgtaaaggacccgtcgtcttcggcgggtcctttacgcatatggaatcaagatgtccgttcgctgacggtgagatatttcaaaatatgaaccggctttgcgcattcgtaacggggtgtgtttacagtaacagacaaatcggtgccacaagcgctgcaaaagccaacatattccaagaatgattcaaagaagcgagaaaatgaccaacgattctcatcacaatccagaagccctcgacaagctcgccgaggactggactgttctgcccaatccgaacccggcatccgatgcgaaacgagaggagctcatcgataggccggcattcggccaggtgttctccgacagcatggcccacatgacctggaccaagggcgaaggctggaacgaccgccgcatcgagccgtatgcgccgctgaagatggatccgggcgcctcggtgctccattatgcgcaggagtgtttcgaggggctcaaggcatatcgccatgccgacggttccacttggctgttccgccctgactgcaatgcggaacgtctgcagaattccgccaagcgcctgtatctgcctgaagtgcccatcgatgatttcctgggttcctgcgccgcgcttgtcgaacaggatgtgaagtgggtgccgagccgccgtgaatacacgctctacctgcgtccgttcattttcgcctccgaggcgttcctcggtgtgcgtgcgcccgaggaggtcgagtattgcgtgatcgcttccccgtccggtccgtatttcccgggtggtgtgaagccggtgagcatctgggtggaggacaagtggttccgcaccggtcccggtggcaccggtttcgccaagtgcggtggcaattatgccgcatcgttgctcggcgagtaccgtggcatctccgagggctgcgaacaggtctgcttcgtcgatgccgcgacgaagacctatcttgaggaactcggtggcatgaacatgatggtcgtgtacaaggatggccatgtggagaccccgagcctaaccggcaacatcctccctggtgtcacccgtcgttcgattatccagctgcttgaggacgatggccatgacgtcgtcgagacgatgatcgccttggaccagctgctcgacgacatcaagtccggcaaggtcaccgaggtcttcgcctgcggcaccgcggcgatcgtcaccccgatcggccgtttcaagtccgagaagttcgatgtcaccgtcggcgacggcgaaccgggcgagctcacgatggcgattcgcaatcagttgctgggcatccagctcggtgagatcgccgatccgcacgactggatgtggaaggtgtgctgagccgacaccagtggcaaccgcatatgcggtgtgcaaggacgatgcttcacggcatcgcccttttccgttgtagtcttgaatgtgcagtatacgcactggcggaacaggaagtctgattcatggaaatagcgttgcagagcacaccgttcttccaggcggtcgagtaccttgcgatcttctcttgcggcatggccgggggactgacggcggtacgcaagcgctatgacgtctcatcgatcatcatcatcgcatggatcaccgcgcttggaggcggaatcatacgtgatgtgctgctcggggcgttaccaccggtgggaatctccgacatggggtcggtgcttactgcgttcgccgccggggcggttacggccgtggtgcatccggaggtcgacaaactcaaatggtccatgatcaccatcgatgcgctggcacttggcctgttcgcggtgaacggcacgagtaaggccctcctgtacaacacctcgggcatgaccgcagtgtttctgggtacgttcacggcgatgggcggcggggtgattcgcgatatgctcgtcaatgaggtgccgatggtggtgcgcgatccccatctctatgtggtgccggcggtgcttggcagcatcttcaccgtatgggtatggcgcgctcatactggccggctgatcggggacaatacggagatgctcctcgatgtggtgattgtgcttgtggtgattgtgctgcgcatctgctcggtgaaattcaacattcgactgccgggcgcggtgcaacgacaccgtgtgcatctgccggccacgctgctgaggggagagagggcgcagacggacaccgacgggcagcgtcggaaagccgcaccggattccaaggatgctccgggaccccggcgcggtgatccggcgtcaagctgatcggacgaacgctcgctccttccagatatccgcatacgcaaaagaaaagaccccggcggttggaccggggcctttgcatatgcgaacgaatcacatggcgttgatctgcagagcgaggctggatttacggttcgcagcctggttcttggcgatgacgcccttgcctgcagcctggtcgagcttgcggccagcgatagcgaaggcggcctcagcggcggccttgtcgccggaagcgatggcttcgcgggtgcgacggatgtaggtcttcagagcggacttgaccgcaacgttgcgctgatgcgccttctcgttcgtgcgaacgcgcttcttctgcgacttgatgtttgccactatctattctccaaacgaagtgtttctataaggacatacaaatgagaagaataccatgatgcggggataaacggaaggtgtcggattccgtgggcttgccgtggcgtatgggtagaatcatacagttaccaacgtataggagggttcgtgagcgagcagcataaccagccgggattcaccgatcagtcgttgatccgtaatttctgcatcatcgcgcatattgatcatggcaaatcaaccgttgcagaccgcatcctccagctttcgggaatcgtacccgaacgcgagatgcgcgaccggttcctcgaccgcatggacatcgagcaggagaggggcatcacgatcaaatcgcaggccgtgcgtgtgccatggtcctatgacggtcaggagtacaccctcggcatgatcgacacccccggacacgtcgatttcacgtacgaggtctcgcgagccttggcggcatgcgagggggctgtgctgctcgtggacgccacgcagggaatcgaggcgcagacactgagcaatctgtacatggccatcgaccacgacctcaccatcatccccgtgctcaacaagatcgatctgcccagcgccgaacccgacaaacacgccgaggagatcgccagtctcatcggctgcgagccgagcgacgtgctgcgcgtctccggaaagacgggggaaggtgtgcgcgagctgctcgaccgcatcgtcgtcgacgtgccggcacccaccggtgatcccgatgcggacgcccgtgcgctcatcttcgattccgtctacgattcctaccgcggcatcgtcacctatatccgcatggtagacggagagctcagatcacgtgagaaacttcatatgatgggtgtgggcaccacctacgacccgattgagatcggtgtgatcagtcccgatatgatgccgacgcgcgcgttgggtgccggcgaggtgggctacgtgatcaccggcgccaaggatgtgagccagtcaaaggtgggcgacacgatcacatccacagcccatcccgccaccgagccgcttcccggctaccgtgacccgcagccaatggtctacgcggggttgttcccgatcgacaacgcccagttccccgagcttcgtgaggcccttgacaagctcaagctcaacgatgccgccctcatctacgaaccggagacatcggtggcgttgggattcggcttccgctgcggcttcctcggtctgctccacatggagatcgtctccgagcggctgagccgcgaattcggtctcgatctcatctctacggccccgaacgtgccgtacgaggtgaccgccgaagacggcaccgtgcatcgtgtgaccaatccgagcgagttcccggacggcaagatcaaaagaatcgtcgaaccgatggtggccgccgacatcatcacccccaaggagttcattggagcggtgatggacctgtgccaggaacatcgtggcacgatgagcaccatggaatacatctccaccgaccgcgtggagatgcattaccgcataccgctcgccgagatcgtgttcgatttcttcgaccagttgaagagccggacgaaaggctatgcgtcgctcgactaccacgacgatggcgaggaggcggccgatctggtgaaggtggatattctgatccagggggagaagatcgatgctttctccgcaatcgtgcaccgcgacaaggcctatagctatggcgtgatgatgacgaagaaactgcgggagctcattccgcgccagcagttcgagattcccatccaggccgcaatcggctcccgcatcatcgcgcgtgagaacatacgtgcgctgcgcaaggatgttctggcgaaatgctatggcggtgatatcacccgtaaacgcaagctgctcgaaaagcagaaggcgggcaagaagcgcatgaagatgcttggtcatgtcgaggtgccgcaggaggctttcgtcgccgcgttgtcgaccggcgaaggcggcaacgaccgcgatacgaaagacaagatccgcgccgcgcagaagagcgaaggctgatcgggccatgtgcgatgcagcagcgccgctcacggcgcatccgccagcttcggcctccatgccattcgaggtgtatgtgcatgtgccgttctgcattcgccgctgcggctactgtgatttcaacacctacacggcactcgacctcggggagggcgcttcgcgcgcaaactatgcgacgttggccattcgcgagatgcgggtcgtgcatgaatggcagttggcacatggtgtggtggagccgcctgcatccaccgttttcttcggcgggggcacgccgacgttgctacctgccggcgatctggtggcgatgctggacgccgtgcgcgagatatggggcattcgtgaggatgccgagatcacaaccgaggcgaatcccgactcggtcgatcccgggtatctgcgcctactgagggacggtgggttcacccgaatctcattcggcatgcagtcgagtgtgccgcatgtgctgcgcacgttggatcgcacccacaatccgtcgaatgtggctgcggatgtcgaggctgcacacaggctcgggttggagacgagtgtcgatctgatctacggagcgccgggggagagtatcgaggactggtgcgacagcgtgcgatcggccattgatctgggcgtgcaccatatctccgcttacgcattgacggtcgaaccccatacgaagatgggcagacgcatcgccgccggtgagatcgaggctccggatgatgatgacgaggccaccaaatatgagcttgccgaccagctgctgagcgctgcggggcttgaatggtatgagatatccaattgggcgcgccccgggcacgagagccggcacaacctggggtactggcgcaacgtggattgggccgggatcggaccgggggcgcatagccactacaatgcggtacgccgcatggatatgggaatcggccatgatcccaaggcgggcataccggtaggtgccaacgggcagggttatccggcgcgtgatacgtggacgtccatgcgcgcatgggacataccgcatccgcgagtctgggcggtggctcttcagcacaatcgtgtgccatggcaggacttcgaactcatcgactgcgatgagaacgccgaggagctgctcatgctcggtgttcgtctgcgggaaggtctcaatgtctccgccttcgccgaacggaccggcatgaagattccttccacggcaatcgacacattggtgaacgagggattgctcacccgttcggacgacgcgctgattgcgacattgcggggcagactgctcaacgatctggtgatcgagcgcctcatggatgccgccttccatcactgaatctcatcattcgggcgtatgttcgccgtgtgacggcatgacatactcccgtaatgatgcgggaaatagaatgcatggagcttagattcccggagcgtgaaattcgcccattgacatccagtgcgttcttcggtatgtggactcaagtggcggcaacgggccgacgcccgctaacctaagttggacaactgcccatggattgccatgaaggagaggtgattgcggtgacttttgcgagcccgctagatttgacgattcatcgcccggaggggatgtatgatcccgctgccgagcatgatgcctgcggtgtcggtatggtcaccaccctcaacacgaggccggaacgcaagatcgtggacgatgccatcgaggtgctgatcaacctcaaccatcgtggggccgtcggagcggaggagaacaccggtgatggtgccggcattctgatgagcatgcccgatgagttcatgcgtgccgtcatcgatgcgccgctgccggatccgaagcactatgcggctggcatcgcgttcctggaccgtgacatcgccaccagcggccagcaggagcaggccattgccaagatcgccaccgaggaggggcttgaggtgctggcgtggcgtgtggtgcccaccaatcctgatggtctgggactgcaggcactggccagtatgccatcgttcaagatgctggtcctggcggatccgcaatcggctttggcgggcgtggatctcgatcgcaaggtctaccgtgtgcgcaagcgcgccgaacacgaggtgggcgtctatttcgcatcgctctcgtcgatgaccatcacctacaagggcatgctcacgacgatgcagctgaagccattcttcccggacttgttcgacgagcgcatgaaggccacgattgcgatagtccattcgcgcttctccacgaacaccttcccgagctggccgttggcacagcccttccgcctcatcgcccataatggtgagatcaacacgatccagggcaaccgcaactggttctcagctcgtgaggggcgcctgagctccaagctgctcggcgacatgaaggaactgctgcctattctcacgccggggtattccgattcgggcaccttcgatgaggtgcttgaactattgcaccttgcaggtcgttccctgccacatgccatcttgatgatggtgcccccggcgtgggagaacaacaaggagctcgatccggacgtccgtgcattctacgaatacaacaacacgctcattgaaccatgggatggcccagccgacatcgtcttcaccgacggcgagcttgtgggggcgttgcttgaccgcaacggcttccgtccgggccgttggcagatcaccgatgacggttatgtggtgcttgcctcggaaagcggcgtgctgccccaggtgggtgaggagcacattgtgcgcaagggacgtcttgagcccggcaagatgttcctcatcgacaccgcgcgtggcgaggtcatcgaagacgacgtgatcaagcatgaactggcaactgcgcatccctatagggaatgggtggaagacaacacggtggagatgaaggagctgccgcagcgtcagcacatcaattattccggccgttccgtacaccggcgccagcgtgccttcggctacacgcaggaagagctcaagatggtgctgactcccatggccaataccggcaaggagccgctcggttcgatgggcaacgacattccgctttccgtactctccagccgcagccgcatgctgttcgactacttcatgcagaagttcgcacaggtcacgaacccgccgcttgactgggaacgcgagaagatcgtcacctcgatcgcctcggcgatcgggcccgaaccgaatctgctcgaagactgtgcactgcatgccaagaaggtgatcatcccgcagccggtgctcacctccgacgagatggcccagctcaagcgcttggatcgcgcctcacagctcggaggctattacaagccgtatgtgatcaggggactgtatcaggtcaccggcggtggcaatgccttggagacccgtctggaggagatcttcgccgaaatcgaccaggccatcgccgacggcagcaatttcctcgtgctctccgaccgcgactccaaccatatgatggctccgatcccgtcgctgctgctcacttcggctgtacagcatcatctgcttcgcaagcatacgaggacccagatctccatggtggtggaggccggcgatgtgcgtgagattcaccatgtggcgctgctcatcgcctacggcgcggccgcagtgaatccgtacctggcatttgagtcagtggaggagctttcccgcaccggctatgtgacggtcgaccccgagaccgcaatcgagaatctgcgcaatgcgctttccaccggcgtgctcaagatcatgagcaagatgggcgtctccacgatcatgagctaccgtggtgcccagctgttcgaagccgtcggcctcgacagcgccgtgatcgacaagtacttcaccggcacggtatcccgtgtcgagggctgcgggctcgacgacctggccgaggaggtggcgatccgccaccgcgaggcatatccgaaccaatggacggcgacaccgcaccgtgtgctgcgcaccggcggcgaatacaagtggcgccgcaccggtgaggagcatctcaacgaccccgaggcgatcttcctgctccagcagtccacccaacgcggcgactacgacatgttcaaacgctattccgcgcatatcaacgacacatcgaaccgtctgatgacactgcgtggactcatgaagttcaacgcggtgcgcaaaccgatcgacatcagtgaggtcgagccggccaccgagatcgtcaagcgattctccacgggtgccatgagctatggctccatctcgaaggaagcccacgagacgctcgccatcgcaatgaattcgattggcgcacgctccaattccggcgagggtggcgaatcaacggaacggctcaacgatccgaaactgtgcagcaagatcaagcagatcgcctccgcccgtttcggtgtgacgagcgattacctggtgcatgccaccgatctgcaaatcaaactggcgcagggagccaaacccggcgagggcggccatctgccgggggccaaagtgccgccgtggatcgccaaggtgcgccatgcaacacctggtgtggagctcatctcgccgcctccgcatcatgacatctactccatcgaggatctcaagcagctcatcaacgatgcgaagatggccaatccgaaggctcgcgtgcatgtcaagcttgtgtccgaattcggtgtgggcaccattgcggccggtgtggccaagtgccatgccgacgtggtgctcatttccggctatgacggcggtactggtgcggccccgctcaatgccatccgccatgccggcacgccatgggagatcggtctgtcggaaacccagcagacgttgattctcaatggtcttcgctcgcgcatcgtcgtccagtgcgacggcgaactgaagaccggccgtgacgtggtgatcgcggcgctgctgggagcggaggagttcggcttcgccaccaccgctcttatggtggagggctgcgtgatgatgcgcgcatgccagaagaacacctgtccacagggtatcgccacgcaggatccggagctcagggcacgcttcaccggcaaacccgaacatgtggtgaacttcatgatgttcattgccgaggaagtgcgtgaactgctcgcacagctcggtttccgcacgctcgaggaagcggtggggcatgtggagtgcctggaccagaacgacgccatagagcgctggaagtccgcgggcatcgacttgagccatgtgctcatgcagagcggtccggttcccggcacggtgctccaccagacgatcgaacagaaccatgagcttgacacggccctcgacaacgtgctcatcgaacaggcgcacgacgccctcgagaacggcacgccagtgcgtatcaccgccgacattcgcaacgtcaaccgtacggtgggcacaatgctcgggtacgagatcacccggcgatacggcgaggatggtctgcccgacaacacaatcgacctgacgctcaacggcaccggcggccaatccatcggcgcgttcattccgcgtggcgagacgattcgcatcgtcggggagacgaacgactatgcgggcaagggcctgtccggcggccgcatggtgatcaggccgaccgacgcgatcaccttcgatccgcatacgaatgtgatcgcaggtaatgtgctgggattcggcgccacttcgggcgagatgttcgtggccggccgtgccggcgaacgcttcggcgtgcgcaacggtggcgccaccttcgtggtggaaggggtcggcgaccatggctgcgagtacatgaccggcggcaccgtggtgatcctcggttccactgggcgcaatctcggcgccggcttctccgggggccatgtgtatgtgcttgaccttgacagggacaagctcaacccccaggccgcctccggcgcgctgcagatcgaaccgcttgatgagcatgcctcggctgttgttcgcgaattggtcgagcgccatgccgccgagaccggctccgtgttcgccaaggagctgctggagcactggagtgagtcggcgaagcgcttcacgcacctcgtgccgaagcagttcgtcgccatgaccgccgccatggacaaggccaaggcggaacacatcgatttcaacgagcccggtgtgtgggaggaaacttacgagcacgtgatggaaggagcgcgctgacatgggtgatccacgtggattcctgaaggtgaggtcccgtagggaaccggccgaacgccccgttgaggaacgcatcaaggattggcttgatgttcatgcggaatccggtctgcaggactggacgcaggaacaggccgcccgatgcatggattgcggcaccccgttctgtatgtcgggctgcccgctgggcaacatcatccccgaatggaacgatctggtgcggcagggacaatgggaggacgcctaccatcgcctgtccatgacgaacaacttcccggaggtcaccgggcgcatatgcccggcgctgtgcgaatcggcgtgcgtgctcggcatccaccagccgccgacgatgatcaagaacgacgaggtcaccatcatcgaccaggcgtgggatctcgaatacgtcaagccgctgccgcccgaacgtctgagtgaccagaccgtcgccgtcgtcggctcggggccggccggcctcgcctgtgcacagcagctcacccgtgccgggcacaccgtcgtcgtgttcgaacgcgacgacgaggtcggtggcctcatgcgctacggcatccccaatttcaagctcgaaaaggggctccttgaccgtcgagtcaaacagatggaggccgaaggcacccgcttccgcacgaacaccgagatcggcaaggacctcggctgggacgatctgcgcagccagttcgacgccgtagtggtggccatcggatcaaccgttccgcgcgatatgagcattccgggccgcgatctcgacggcatccatttcgccatggagttcctgcccgacgcgacccgtcgtgtgttcggcaagcagccgatccatgacatcacggccaaggacaagcatgtggtgatcatcggcggcggcgataccggttccgactgcctgggcacttcgattcgccagggggccaaggatgtgacggtgttgcagatcatgccgcaggaaccgacgaagcgcccggacaaccagccttggccgaccttcgcccgcctctaccagaagacctcctccatggaggagggcggcgaatacgtctacagcaccgattcagtgaacttcgtgggttccgaggaggacgccgccaagatcacggtgagcgacaatacacagaccgagggcttcatctccgatggaaacggtcatgtcaccggcctcaaggtcgtgtcggtggcccccggcaaggatggcccgttcacccgccagccgggcaccgaacgtgtgatccccgccgacttggtgctcatctcggtcggcttcctgcacccagataccgaaaccctgcaggcgcagttgccggtcgacctcgatggtcgtggcaacgtcgcccgtgacgacgcattccagacctcgcaggatggcgtgttctcgtgcggtgatgccggacgcggccagagcctggtggtatgggcgatcgccgagggccgttcctgcgctgcggccgtcgacaggtatctgaccggatgcaccgagcttccggcccccattgtcgcctcggagcgcccgatggcgctgcctcgccgctgatcaagaggagcaagcccccgaagcgaaggcggtcccgggtcgggaccgccttcgcttctacgggctaagtcacgacggacggcgctggttcatgccctcggtgcgctagagtatgggtgttggacttttacgaaggagaagacatggccaatcgtgcgcaacgtcgttcgaaaaacaacgggggaatgccctcgcagtatgactcgacacagggtcgtggtcgcagtggcatgatcgacgagtcgcagttgcaggagcgttcccgtcggctgaaggagggcaagaagggcccgtggaagccatcgagcagcgaacttgagaagtacgaggagatcgcgctcgacacggatccagacaactacgacccgccacaggtgcttcgtgccccacattccgggcgccaatgggcgcgtctgttcagctggatcgtcatcgtggtgtccgccatctcgttcttcgtggtcatgtgggtgcctaacctgccgatgtgggtgatcatcacggtgtgtgcagtcttcgcctgcggtgtgatcagcctgttcttcacggccggtgattcgaagaacaacccgaacctcgatcagaatggaaccgccgtctgatcagacgcatgcaggggcgatggctggggcaaaaggaaggggccgcggcgatgagcgcgaccccttccgggaacgaatatgccttacttgatcttctcgatctgctcgagcagttcgtcgatctggccgttgacgttcacgtcgtagccggcgaagcgaatcgtgtcgtctccgtcgagcacgaaagtggaacgaatggtctcgtaggtttccttgccgtccttctcgtgctccttggcggcgccgtacagcttgtgcacggtgaactccgggtcggagagcaggatgaagttgaggtcgttgctcttgcgaaactcctgcagcgccttcacatcgtcgggggagatgccgatgacggcatatccttcggcctggaaacgctcgaggttgtcgcggaagtccttggcctcacgcgtgcacaccgacgtgcccgccttcgggtagaagtagagcacgacgttctggtgcttgaagtccgcaagcgcatagtgcttgtattcgtccgattcgagttcgaaattcggtgccttatcgcctttgttcaggcgtacaatgttgttttcactcatgtctccaacctagacccgaacccggtgtctgtataggcaaatacgcgaatagagtagttttcgcgcgttgggggaacgcccatgaatcaattacgcaaaaagcgacgtgttgaccatctgcttcggtgtgcggttcgcgacgccggcggaacggatcgttccaatatacacaatccattgtgtttctcgcctccgaaggccgtattgtggtgtatgcagtcgtatgcatggaactcatggaagaggcgattatgaaagttgacattctcacccgcgaatacccgccgcatgtctatggcggcgccggcgtacatgtggaggagctggcgaaggtgttggccgaacgcatcgacgtgacggtgcgcgcattcgacggaccgcgcgaatccgaggcggcgcagcacgacggacgcggctcgttgcgtgtgataggctatgatgtgccgacggagctggatggcgacaacgcggccatccgaaccttcggtgtggatctgcagatggccaacgacgtcgacagtgaactcgtccacgcccacacctggtacacatgccttgccgggcgcatggcgcagctgctgcatgacatcccgctcgtgatcacggcccattcgctggaaccattccgcccatggaagcgcgagcagctcggcggcggctacaatctgagctcctgggccgaacgtgacgcctatgagcatgccgaccgcatcatcgccgtgtccggcggcatgcgtgaggacattctcgccgcctacccgaatgtggacccgaacaaggtggtcgtggtgcacaacggcatcacgcttgccgatttcgagacgccggcccccgatgatgccggctgggcggtgttcgaccgctaccacatcgaccgcgacaagccgaccctgctgttcgtcgggcgcatcacccggcagaaggggctgccgtacctgctgcaggcattgcatttcgtcgacccggacatccaggtggtgctatgcgcgggcgcgcccgacaccccggaaatcggcaaggaggtcaaggaggcggtggctaggctcaatgaggagcgcggcaacatcatctggatcgaggagatgctgccgaagcacgagctcaacgcgctcgaacacggctgcgatgcgttcatctgcccgagcatctacgagccgctcggcattgtgaacctcgaggcgatggcttgcggtctgccggtggtcgccaccgcgacgggtggcattcctgaggtcgtcgtcgacggggtgaccgggtatctcgtgcccatcgaacagaagcacgacggcaccggcacgccgacgaatcccgaacggttcgtgcacgatctggcggatgcgatcaatgagatgttcgccgacccgcagcgggccaaggacatgggtgaacgtgggcgcgaacgcgcacgcgacaagttcagctgggagtcgatcgcggaccagaccgtcgccgtgtaccgcagtgtgctcgaggagcgtgcggcgcagcacgaataattcgcggcacggcaagcaagaggaagcgggctggatcccatgcaacgggatccagctctcatatgggggtgcaatggaaggactggactgcgaaacacgggcgttggccatgcacaacgtgcatctgcgacggtatggccgtgtgatcgtggatgacgtgaatctggagatcggacgcggcgagaaatggattctgttcgggccgaacggcattggcaaatcgagcctgatctcgatgatgagcacacgcgcgttccccacatccggcgacatcgacgtgctcggacggcgccttggcaaggtcgacgtgttctcgtaccgccacctgatcggactgagctcggcggagctgtcgcgcgcgtttccgccgttcgaagacccgcttgacgtcgtggtcaccgcgctcagcgcgacgaccggccgttggaaggacacctatacatccgacgaatacgcccgcgcgcgcagactcatggaagatttcggcatcgcataccttgccggcaagcagttcggtcgactctccgagggggagcggacacgcacactgatctgtcgtgcgctcatggcccaatccgaactgctcattctcgacgagccgacaaccggactcgatctcggcgcgcgcgagatcacgattcgcgcgttgtcgtcgctgcatgacgacccacgtacgattatcgtcgtcacgcatcatctcgaggagatccctcagggttttgaccatattgcgatcatgggacgccagtcaaccgtcacgtcgcaacccgaccctgccgatccagcaccgggaacgatcgaatatgcgggtgacctcgaacacgggttgaccgccgaacggctgagccgactgttcggcatgccgctcgacgtgcaccacatcgacgaccgatggagcgccttcgcccgaatatgagcatgtcggcgacgggaaggccgacggatggtgtagacgagcttggctacagtggatttacgtccaatgagcaagcagagcatggagtcgagagcgtatgcgcagaggtccgttgcaatccggtgagaaagtgcagttcaccgaccgcaagtcgaacaagatcaccgaccaattggttgcgggcggcgtcacacagacctcacatggcatcatcctgcatgacgatgtgatcggcaggaacgagggcagcgtggtcaccaccgtcaccgccaagcgtgaggaccaattcaacagggagcacccggaacgcgatacggcgaaaccatggaaggctgcgcgcgcaatcggcggctggcagttcgcggtgatgcggccgcgcatggccgactatgttctgtcgatgccgcgtggcgcacagatcatgtatccgaaggacatcgcgcaggtgattgagctcggcgacatacgttcgggcgcccgcgtgctggaatccggggccggttcgggtgcgatgagcctgcacctgctcgacgcggtgggtgagggcggctgcctgaccacgatcgagatgcgccctgatttcgcgaggatcgccgaggcgaacgccacattgtattacgggcgccgaccggattggtggaatcttctggtcggcgatttcgattcggtggcctccacgttgccggaacaaggattcgaccgcatcatgctcgacatgctcgatccctggaaccgactggaacaggcgtatcgggtgatcgcgccaggtggcgtgctcgtcgcctatgtgacgacgaccacgcagatgagccgtatggccgaagcgctgcgggagagtgagcattggaccgcaccgcagatccaggagaccatggagcgcaattggaaagcgcagggtcttgcagtgcgtcccgaccatcagatgatcggccacaccggtttcctcatcgtctcccgggcgatggctcccggatacgatgcgttgcgcaagcgtgaccgtgccacgaaggacacgacgacggatatcgactcactctccgtagaggagcgcgaggcatcgctcgaggagcttgagcttcgtgacatctccgaccgcaagctgcgcaaggtgctcagggatctggacgaacaacgcagtcatttggattctcaatgaccgattatcgccgggcgcgacacgatgcactacagcatggctggaattagaatgggaagggtgcgggtcggtcaggcccggcgggatgcatggaggaagcgtgaatctgaagaaagtggcgaagagggccaaggaatacaagcacgtgctcatcatcatgcgccatgcgaagacggaggccttcaacgcgaagggcgattttgagcgtgtgctcaccgacaaaggactcaagcaggccaagcgcgtggcgaagggtctgcgcgacatgggattggtgccggatcagatcgactgttcaagcgccacccgggcgatgcagacatgcgagcgcatgctcaaggtgttcggcgacgctccgaaagtcgactactaccaggatctctatgcgaaaggtatgcaggcggtgttcgacatgctcgctgcctgcaaggacaaacgccatgcgctgctggtgctcggccatgagcccaccgtctcgctggcgagccagtggctggcaggcgaacaaagtgatccgggccagctcgatctgctgaaccttggcatgtcgactgccggcgtggcgatattcggttcgaatgcgccgttcagaaaatgggggacccatgaggcgaatctcattgcggtgctcacgccgaaggagttcgaaaagtagcaggcgcaggcgtcgacggcaggctataagtgtgccttatagcctttgaaagaaaactcctatgcgccgtttttaagaatttcgggcttgcaccggttccagtttgctaacgtggtctccattgcatcgacacgactggaggatccatgaccattcccacatccatctcgggtttcccccgcatcggacgcgaccgtgaactcaagaaggccatcgaagcctattggaaaggcaatgccacgctcgacgatgtgcgtgagaccggccgcgagcttcgtgttcggcattggaggttggaaaaggacgcaggcattgatctgatcccgagtaacgatttctcactgtacgaccagatgctcgacaccgcggtcctgctcaatgtgattccggcccgataccgtcgtcttggttttgacaaccctgaggagacactgttcgccatggcccgcgggtaccagggtgagcgtggcgatgtgaccgcattgcccatgaagaaatggttcaccacgaactaccattacctggtgcccgaattcgactcctccaccgaggtgcggctcaacggcacgaaaccgttcgatgagtacttggaggcgaagtcgctgggcatagagacgaagccggtgctcatcggcccatacaccttcctcaaactctcccgcgatgccgaggcccaggagctcaccatcgacgaggggctcgtggatgccgtggccgacgtgtacgccgaggttctccggcgcttcgccaagctgggcgcgcaatgggtgcagctcgacgaaccatatctggtgctcgacaagcacgagggtgacgtctcgctgttcaaatcgctctattcgcgtctgctgccggcgcgggacagcggtgtcagggtgctgctcaacacgtatttcggcaacatagccgatatttacgaaacagtgaagctcttcgaattcgacggggtgggactcgacctcatcgaagggcgtgacgagaacctcaaggccgtcgaacaccatggtgtagcagcacgcaccacgctcttcgcaggcgtggtcaatggccgcaacatctggcgcaacaactatgcggaaagcatcgcactggtggaggcactccagcaggtgaccgccaacgtcgcagtcgcttcggcctgttcgctgctccatgtgccgttcagcaccaagggggaggaacagcttggcgacaaggtgctgcgccatttcgccttcgctgtggagaaactcgaggaggttcgcgagatcgcagacctcatgcagctcgacgacgatgcgaagcgtcagtccactgcgctcgccgccaaccaggcgctgttcgatggcagccgtgtggtcgccgacgaagttgtgcgcgcccgcatcgccgcccttgccgatgcggactatgtgcgccgacccgagcgtggcgaacgccagcggctccagcgtgaggcgcttggcctgccgttgctgcccactacgacgataggctctttcccgcagaccaagcaggtgcgtgccgaacgcgcccgccttcgcaagggtgagatctcccaggggcaatacgacgaattcattcgacgtcagatcgacgatgtggtggccaagcaggagcagatcggactcgacgtgctggtgcatggggagtttgagcgcaacgacatggtcgaatacttcggtcagaacctcaacggtttcctgttcacgaagaacgcctgggtgcagtcctacggcacccgctgcgtcaagcctccgatcatctggggcgatgtgagccgtgcccagccgatcaccgtggcatggagctcctatgcccaatcgcgcaccgccaagccgatgaagggcatgctcaccggccctgtcaccattctcaactggtcgtggccccgtgaggacatcacccatgaggagcagaccaagcagttggccctggcgattcgggacgaggtccttgacctcgagaaagccggcatcaggatcatccagatcgacgaggccgccttgcgtgagaaactgccgctgcgtgaatccgactggcatcgtgaatacctcgactgggcgattcccgcattccgtctcgtgcattccgccgtgcagccaagcacgcagatccacacgcatatgtgctattcggagttcaacgacatcatctcggacatcgacgccatggatgccgatgtcatctcattcgaagcctcccgcggcgatctggtggtgctcgacgccatccacgacgcccacttcgaaaccgaggccggtccgggtgtgtacgacatccattccccgcgcatcccctcggtcgaagagaccgaggagcgcatcggcgagattcttgcgaagatggatgtgaacaaggtgtggatcaatcccgattgcggcctcaagacccgaggcaatgacgaaacctggccgagtctgacgcacatggtccaggcggcgaaagccatgcgcgccaacctcgactgattcgggctcctccaaacagtccgcaggacaccataatcgcagtatgcatgccatggcggcatatccgcccactgtggcatacatactgcgtatcccatcagaatgcacgcatcacacagcacgagacccagcaaatgcacacgccaatgttctcccttgaagtattcccacccaaacgcacatcgccggtcggcacgatctacgacaccctcgacgggctgaacgacatgaaacccgacttcatctcggtcacctacggcaccggcaaatcagcggaccgcacggccaccgcacgcatcgcgcacaccatacactcggaatacggcatagacgcggtcgcccacctgaccgcacagtacctcaccgcccgggatgtcgacgaggcgctcgccatgttcgatgaggcgaaagtgagcggcgtgctcgcattgcgcggagaccgcaacagcgagcgcgaaccggccggcgtgttcacccatgccagtgatctggtgtgttacattcgcgaacgtaggccgaatctgaagatctatggcgcctgctatccggagaagcacccgcaggcggccacgctcgacgaggatgtggcgaatctcaaagccaaggtggatgcaggcgcctcgcatctgatctcccaactgttctacgacgacgacgatttcatcgcattcctcggcaaagcacgggccgcgggcatcgatgtgcccatagaggcgggcatcatgccggtcaccaatgcgaaatcggtgcggcgcatgacgaacatgtgctcatcccgggtcccgcgcaagctcgaacgcatgctcgaaaagtggggagacgatcccaggacgctacgcgaggcgggcatcatctatgcgagcgagcagatcagcgacctcgtggctcagggagtcgatggcgtgcacctgtacacgatgaaccatccgtcggtctcgcgcagaatatggcagaacgtgggcaatctgttcgaaaaagcgtgacccaatttcccagcgcaacaaaaacacgctagattgacaggcatggagatcgacgagaacaccaccccaagcacacgagacatcattcatgccggattcgagaatctcggccgtgcgaaggaactgctcagcgaggtgtgctcggcgggggatctcgaactcacccagcgggaactgctcggcgaactggcgcattgcgcggatccggacgtggcattggacgcattgcatgaactgatcatcagctttgccgaccgtcccggaaaactgcacggactgctgcacggtaggtctccgcgcacattgctgcaggtgctcggtgccagccggcaacttggcgtgctcatgcggtcgcgacccgaactcgtcgaggcggcggctgtcgattccctccacagcgcggggtttgacggcgaggcgagacgtgcgaccatgttggcggcgatcgatgcccatgaagagcagctcggcgccgcggactcttcggactcctcgttccggcgcctgatcaccgacgtgccgttggcggaggcgaccaataggttacgacggaactattacgaacaactggctgcgatcatggcctacgatgtttcgcacgacgacccgatcgcgattcaaccggcggtgtcccgcgcgttgtcggatctggcggacgccgccctggaaagcgcgctggccattgcgcagagcaacacggaggagtccgaactcctgcgcttcacaatcattggcatgggcaagctcggcgcacaggagctcaactacgtctccgatgtcgatctcatctacgtggtggagccgatggccgagaccatgtcgcaaccgcagctggtcaaggtcggttcgaagatcgccatgctcatgcagaagatctgccaatcggtgatgcccaatgtgatggagcccgcactgtggcagatcgatggggcattgagacccgaaggcaaggacggtccgctggtgcgccgtctggactcgcataaggcctactaccggcagtgggcggagagctgggagttccaggcactgctcaaggcaagggctgtggccggtgacgtgcctcttggcgaggcatacatgcagatggcatccgaattcgtctggcaggcctcgcggcgcgagaacttcgtctccgactgccagcgcatgcgcgaacgtgtggagagcctcatcccagtgccattgcgcgaccgtgagatcaagctgggccgcggaggtcttcgcgacgtggagttcaccgtgcagatgctgcagctggtgcacggccgcgccgatgagaccctgcatgttcgctccacgttgcaggcgttgcaggcgctttccgatggcggctatgtctcgcgccgccatgcccgcgtgctctcccacgactaccgtttcgaacgggtgcttgaacaccgccagcagatgtggcagctcaaacgcacccatctgttccccgacatgggcaatgcgaacgccggcggattggagaagaagcgcacggtcaatgtggaggagctctcgcgcaatgccgaactgcacaggctcgcccgcgtgttcggctggcacaacgaggagctggtggacaatttcgacgagacacgcaggcagatccgtcggctccacaacgaaatctactaccggccgatgctgccgatcagcgcggtctcgggcgacgaacgcgtggaactgagcgagcaggcggtgatggatcgttacgccgccatcggtttcgccgacccgcaggcggcgctgcggcatgtgcaggcgctcaccgccggcatcacccgtgccgcgaagatcaatggcatactgctccccgcggtgctgcgctggctcggtgaagggcagaaccccgacatgggactgctgggctggagcaacctcgaggaacggttcggttccggcagcgactacctggggttcctgcgcgactcgcagtcggccgcacagcggttgtgtcacgtgctgtcgaattccagattcctcggcgacgcgctcaacaagtcgcaggagtcgatccgctggctcggcgatgacgaccaattgcatgcgcgcacacgtgaatcgttggatgtgggctgtcaggcgatcatcacacgatatgatgattcactggccgacgcggcgaacatgctgcgtgcactgcgccgccatgagatcgagcgcatcgggatcggctggatgaccgatgtgatcgattcggcgcaggccctgaatggtatgaccgacgtggttgactcgatcatccaggcctcgctgcaatgggcggtgcatgatacgatgcgggcgaacggcatggatggaccggctgcgcatctcgccgtcatcggcatggggcgttatggcggccgtgaggtcaatttcagctccgacgccgacgtcatcatcatctaccgtcctgcgcacggcgctgacgattccgccgcgaattcgttcgcccgcaaggtgcaggagcagatgcgcatgatgctcatgggtccggtgtcgacagaaccgaagatcgaactcgacatggacctgcgccctgagggcaagaacgggcccgtcgtgcgctcgtacgcctcgtgtgaggagtactaccgtgcatgggcaagcgtgtgggagcgccaggcgctgttgcgcgcccgattcgcagccggcgacaaggagctggccgaggactttctggcgaatgtcgcgaacccgttccgatacccagccgagcgtctcaccgacgaccagttgcaggagatacgcagactcaaggcgcgtatggaggcggagcgtctgccacgtggtgtgcgacgcgaccggcatctcaaactcggcaggggaggcctgtcggatgtcgaatggaccgtgcagttgctgcaattgcagcatgcgcatgacattgaggcgttgcaggtgaattcgacgatgcaggcccttgacgtcttggtggagcatgggctcatcgtcatggaggacgcgaagatactgcgtgacgcctggcagatgtgcacagcggcgcgcaacggcaactatctgtggaacgggcgggcgaaccgcgccgacatcctgcccgaccagcatttcgacctgagtggcattgccacgtatcttggctacgatccggatcgcggtcagcagttcgagaacgacattctctcgcaaatgcgcaagagtcgtgaagtatgcgaacggctcttctacggtgttgaggagtgagatacgctggcgggtatgaatgggcatgatgacgaatccacgtgggtggagcacaccctcgtgcggctcggcgaatcgcagttccgtgcgaagttcgtgttgagcgaggctgatcggtcgtatgcgcgcgacaagggcagacatgtcatcgacaggcatgcgcatgagatgctgcgcgcacgcgtgggcgaggcgcaaccgtccaacgacggcaggcagacgccttggcgcgggcacccggtgttcaccgcccagcatgcgacggcgacatgctgccgcggatgcatcgagaaatggcatggcattgccaaaggtcggccgttgaccgatgccgaggtgaacagactggccgatctcgtcatggcttggatcgacagggatctgacgaatcatccggcccgggacgcagttgcaggcgcccgttctgcacaggctgatgccaggcgcgtgaaggcggcccatgccaaggctccccggtatgtgcagccggaattatgagggcgtgtcgagccggcggggcagtggggtatagttggagaggtcacttcggtgatcacctggaacagcacatgcatgaaaggtgagccattgtctagcgttcagcaacacgccgacggacagtccatagtgggaaccagcgtcatcaccctcgacgatctcacagtcacgcaaatcgaggagttgctgcataaagcgcagtacatcgattcgcatcgcaaggaagtggcacacacctgtgacggacgggtgttggccactttgttttatgagccaagcacgcgcacgcgactgagcttcgagaccgcaatgctgcggttgggcggcaaggtgatcggttttgcgggatcgcagctgagctccgcaacgaagggcgaatcgatttcggacacgttgaagaccgtgtcgaactacgtcgacgtcgtggcgatccgtcacccgaaggaaggcgccgccctggtggccgcggacgcctcctcggtgccggtgatcaacgccggcgacggcggccacatgcacccgacgcagacgctcgccgatctcgcgacactgcagtcgcgattcggacgggtgaacggcctgacgatcggcctgtgcggcgacctgaccttcggccgcaccgtgcactcgctcatcgagacgctgtgccgcttcggcaacgtgcgtttcgtgctcatctcaccgaaggagctgcgcaccccgcaatacgtgctcaaccgcatcaacgccacgcccacctgctcgtacgaggaggtcaccgacttgagtacggtcataggggatctggacgccctgtacatgacgcgcgtgcagaaggaacgcttcttcaacgaagacgattacctgcgcctgcgtgacacctacattcttgacgagggcaaactcgcgaaggccaaacccacgatggcggtgctgcacccgttgccgcgcgtcaacgaaatcgccacggaggtggacgtcgacccccgtgccgcctatttcgaacaggtgaagaacggcatgctcatgcgcatggcattggaaagctcggtgctcggcgacgaattgcccggctacgagcagtatgcgaaccaggaggtcgaagcctgatggaagtcactagcatccaggatgggatcatcatcgatcatgtgcctgccggcaccgcgctcaaggtgctcgaatacctgcgcatcgacccggccaccacgaagctcgcgctgatcatgaacacaacgagccgacggtacggttcgaaagacatcatcaagatcgaggacgcccaggacgtcgacctcgacgtgctcggactggtggcccgccaagccaccgtcgacatcatccacggcggccagattgtgaacaaacagacgccgacgctgcctgaacgcgtggtcaatgtgatcacctgcgtgaacccgcgctgcgtgacgaccaccgaacccggcatcgaccaggtgttctacctcgaccacaccgacgacgaggtgtaccgctgccgatactgcgacgaggaggcgaaattctaaatggccatcacattcaccgacatcacggtgtgggacacgggcgaacacatcgacctgaccgtccccgacccgcgtgacgtcaccatcgacgccagtgcgctcaccgtggcgccgggcttcgaagatccgcacgtgcacttccgcgatcccgggcagacctacaaggagtcgatggtctccggatgcatggccgccgcatcgggcggttacacgaacgtgctcatcatgccgaacaccgtgccggcgatggacggccttcaagtacacgagggggaacccggcgcgcaggagattctcgatgccggctaccacacggtgatcgattatctgcagcactatgaacagatccaccacgtcacgctgccggtacgctacgaactgtgcgtatgcgccaccaaaggccgggccgggctcgaaccgaccgacccgaaggactgggcatggtacatgccgggccatgacagtgagaaagaccccgcacagatcgcccaccccgtcaccgcaatgagcgacgacggttcagccgtgccagaaccagtgctgcgccaggtgttcgacaacgtcaagagcaccggactatacctcatcgagcactgcgaacaccatgacgtgggcgccgtgaacgaaggtcccgtatcccatgccctgaacgtgccgggaatccccgaagacaccgaactggcgatcgtgcaacgtgacatcgacctcgtgcgcgaaaccggcgtgcacgtgcacttccagcacgtgtccaccgcaatctccttcgacgccattcgcaacgcgaaggccgaagggctgcccatcacctgcgaaaccgcaccgcattatctggcattgaacgacgaggcgctgctcgaatacggcacgctcgcgaagatgaacccaccactgcgcggcgaacgggatcgcttggccacgatcaaagcgatcgaggacggcaccgtggacatgatcgccaccgaccatgccccgcacacactcgaagagaaggcccgcggattcctcgaagcacccaacggcatcatcggactggaatgcgcctatgcggtatgccacaaggtactcgtcgacggcggccacatcagcgaccagcgactcatcgagctcatgtcgctgaatccggcccaactgatgggacggcattccaccgacatcgccgcattgctcaacacctcgtcgaaatgcgcggtgaagcgctcgctgaacctggccgaagtggaacacccggagctcgtggacctgaacattctcaacaccacggagcagtggagcatcgacgcgggccggttcctgtcgaaggcacgtaacacgccattcaacggctgggatgtgagcggcaagccgtatgcgacgatcatcgcatccgctctggtgttcgaccgactgggatttgacgaggcaaccgaaacggaaacaggggagtagcgattatggaccggctcatcgaagcaatcgaagacaaacagaatcccagtgtcgtgggccttgaccccaccgacaaactcgttcccgcccccgtgatggatgcctatgccgtcgaagccgaggaacaggtggagtcggacgacaatctggcagccaccgctgccgcagcagcgtatttcgaattcaatcgcgccatcatcgatgcggtgtacgacatcgtgcctgcagtgaagccgcagatcgccatgtatgaggcgctcgggcccgcaggcatcgactgttacacgatgacatgcgaatatgcgcaaagccgcggcctgtacgtgatcggcgatgtcaagcgcggtgacataggttcgaccgccgccgcctacgcgcatcatctcaccggtttccaaggcgatgacgtgtggtttgaggacgcggtgacggtgaacccgtacctgggttccgacggcatcgaaccgttcatggaggccgccgggcaagccgatcgcgacatgttcattctggtgcgcacctcgaatccgtcgagctcgcagattcaggagctcgaattggccgatggcggccgggtgtatgagcatgtggccgatctggtggaggattggggcaaggattccatcggccgtttcggctattcccgggccggagccgtggtcggtgcgacgcatcccaaggagggtgccgcattgcgcgagcgcatgccccacacgttcttcctcgtgcccgggtacggggcacagggcggcacggcacaaagcgtggccggcatgttcgaccacaacggttccggcgccattgtgaactcatcccgcggcatcataggcgcctggcgtaacgacgagcaatacagcgattcactcgaaccggaatccgcgctggaactcgtagccgtcaacgcccgcgcagcggcggccgatatgcgagaccagctgcgcgtcgcccttgcataaccgatatagatttgtatgcgatagccgtccgtacggattctcgcacaccgaacaaccaaggagattcatgccaaccgcattcacccgcacggtggaacaggcccaggaggccggtttcaccccgaccaggcgcaccgtcagcattgtcgccgtgaagcaactcactgcgggcatcgtccgtcttaccttccgtgacgaatacatcgcccaccatgttcgacctgcgcagttcgtgaatctgtattcgtcgaaccccatgcacctcatgccacgtcctttcggagtcagcgaggtggatggcgacgaggtgagcctcatcttcgcggtggtcggtttcggcaccgacgagttcagcaagctgacagcgggggacaccatcgatgtgcttggcccgttgggcacgcccttcaatctcgatgaggctgcggattatgtgctcgtcggcgggggtctcggcattccgccgctgctcgaggccgcgcagagcctgcgtgatgaggcggattcgcgggcgatcgccgtgttcggctatcgtgacgagcatttcgccgacatctatgctgccaagtacgcggacgaagtgcacagcatcgacgagtcggagggcaatgtgctcacgttgctcgaacgtctgtggccggcattggaggagagcgggcgcaagacgatcattctgtcctgcggtccgacgccaatgatgagagccgtggccacttgggcctccaaacgtggcgtggacgcccaactgagcatggagcagcgcatgggatgcgggtatggcacctgtgtggcctgcacaatcgacacacgtgccggccgcgagaaggtgtgtgaggctggtccggtcttcactgcgcaccaattgggttgggacgccgatggtgccgaggcgaacgccgatgcgtgatatggacgagcgggcgaaggagaacgagacgatgaacgagaccacaagcagtgtgtacgaaccgcatgagtggaagcatggcaccgtggttgcaggcataccatggaggaacccggtgggcaccgcctctggcacgttccaggtggacgcctgcggccagttctacgatgtgagccagctcggcgccgtcaccacgaaaggcgtctcgccggtgccatggcttggcaatcccggtgtgcgcacggcggaatgcccggccggcacggtgaacgccgtcggcctgcagaacccgggcgtcgaccattacctcgaatatgacctgcccaaactcaagaacatgggcgccacggtcgtctctaatgtggccggtcattgcgacgacgactacgcccaggttgtcgccaagctcgccgactcggatgccgacatgctcgaaatcaacgtgagctgcccgaacgtgacccacggcggcatgagcgtgggcaccgatccgatggcgttgagccggctcatggagcgtttgcgcccgatgaccgacaagccgatgatcgtcaagctcacgccgaatgtcaccgatatcacggccatcgccaaggcggctgtcgaatccggtgccgatgcgctgagcatgatcaacacgctggtcggcatgcgcatcaatatcaaaaccggcgaaccgatcatcgcgaaccgtaccggcggtgtctccggacctgccgtgttcccggtgggtctggcctgcgtgtggcgtgtgcgcaccgctctgcccgatgtgccgatcatcggcatcggcggcatcgactccggcgagaaggcgctcgaatacctgtatgcaggcgccaacgccgtcgaggtgggcggcgccgcgctctacgacccgaccgcaccgatccgcgtggcgcgtgaactcgacgatctgctcgactcacgcccgcaattggcacacaagctcgtcaagggcgacacctggcgctgacccgtcggcgatgcccgttcgccgttccgattccattcatgaccgtcaatcggcgtattcgggacaaatcgaacccggagatgtcccgaatacgcagattattcgcgcatccgtttaccagaggggagaacccacagatgaccgaagcattggatacccgtttcacccagtttctgctcgaatcgcaggcgttgaagttcggctcgttcacattgaagtcgggacgccagtcgccctatttcatcaacgccggcgccttcgatgacggtgcgaagatcgccacgctcggtgaattctatgccgagaagatccaacaggagatcgccgcaagcaacctggccgcccgcatcgacaccgtgttcggaccggcatacaaaggcatcccgctggccgtggccaccacgatcgccatgcagcaccgcttcaacgcctccatcggctacaccttcgaccgcaaagagaagaaagaccacggcgacggtggcacgatggtgggcaagccactcgaggacggcatgaacgtgctgctcgtcgacgatgtgatgaccgccggcaccgcagtgcgcgaggtcgtccccaagctcaaggcgcaggccgacgtcaacatcgtgggcctcgtcctctccgtcgaccgcatggagaagacgaaggactcagatctctccgccgtgcaggacgtgcaacgcgagttcgggttccccgtgttcgccattgcgaacgtcaaggagatcttcgccgccggacggcagctgatcggcgagcacggccagccctacgtcaccgacgagatcgccaaggccgccgaggagtatctgacgcagtacggggcgtgagtgggctgtcatcattttcagtgggcaacaggtctcctcgttgcccacttttcatgcattgcatgaggaaggaggtgtggtggttacgcttggcacaagcataagcctatcaggtgaaatacaggctcccttgcaagcattccaagacgcagttcctctcggaagaacaatgtcgatgatcaatgcacggtggcatcatcgaagtccatcggcacacatatgcctagatgcgggtatggcggcgacaatccgcgcctaacatccaataggccgtccacgaatctgcacccgcagctgggatacgcccaaaaactggaagtatattgcggcccatcattggaggaagtatggtgatatcggccgcagcgacagtgacagaaaacctcacactgagactcatcaggaagaaatagaacgggtttccttcggtcatatgcttcgcttcagaacaacaaaaccggaagagatacggaaagaacgcctatgatccgaccaatgacgatcgacgactacgatgccgtctgcgcatgctgtatgtcatgcaccggcatggggctcaacaccatcgacgactcacgcgacggcatcgccaaatatctggcacgcaacccgaccacatgcttcgtggacgagcgtgacgggcgcatcaccggcgtcatcatcgccgggcacgatggacggcgcggatacatctaccacaccgcggtcagtcccgaccaccgccaccagggcatcggcaccgcgctcgtcgaagcggcgttacatgcgctcaccgacgaggggatcgccaaggtggcgctcgtcgtcttcgcccgcaacgcggatggcaacgcgttctggcagcggctcggattcacatcgcgcgacgacctgacctaccgcaacaaggcgctcgccgaactcacgcgcatcgacacctgaatctcactaatatcccaactttccgagcatgccccatgctcgctccagcattggcagctcacgcgccgcaatcagtctgccgagcttggaatcctcgcatctcctgtattcggcgatggcctgagcataggtgagcttcaatgtcgacagattgaatctcgtccgctccagctccgtcagattcgtctcgccgaacgaaagcgcctggcacaggtagtagtgattgatattatggcggtgaatccgattatagcaatcgctgaccaagccaatctcgccgagaatctcaatctcagctccaagctcctccctaacctcgcgcatcaccgcctccgtgggagtctcacctggttcgatgccgcctccggaggtttcgatcgtcaccgcattgccgaagacgtcggtacgctgcacccgcagaaaatagaagtacgcgtgagcatcgatgacgatggcccgcgcgattggccgatcatgatcaatatattcgaacggccattcggcatcttcgagctcaagactcaatggttcctcagtcataccacctccatgattgtacgagcatcgccaattgactggcacgctctctccaagacgcaagaggagacacctccagcgtcagcatgtccttttcacgtcgatgagatgcgatgaaatgaaatgcaatgattggcatcgcggacatgatttgggatccgattcgcacgcacagtcatacggaatcagccacggcgatacgccatcgtatccacatgcgcactcaccgtctcgaccagctcgccaagcggcttgagaaaccgccgacccaacgacgtcaactcataatagacctgcggcggcttcgaacgctgcagcacctcacgacgaaccacgccaatctgctccaggtacttgagcgtctgcgaagccatacgctcgctgatgccgccgatgttatgcaccaattcactgaaacgcagcggtttcttctcgagggccaggatgacgagcagtccccatttgccgctgatcacctgcagcgggaagcgtgcggggcagtcctttgcgaagatatcgagtttttccatggcggtagtgtaacagatgaaagtaacggaatataacaaccttacgaatagtaagtttcaaaacttactattcaactgaacctaaaaccctccaaatcatcaccacacaattcatactttcctgcgacgagagcagtggagcattctcttgtgacgtccacattcgattttcatgcgttgtacgggcgatgttcgaaaaagagcggcggctcgtcaaggtctctatagaatgcatcccagcgggtcagcacgtcacgcaagggcatgggcagataggagagcgcctgttcggctatgctgtcgggaatgccataggcggcctgtgcaatgctcgcagctatggctgcctgcgtatcgctgtctcctcccaatgagaccgcattgcgtatggcatcctcgaaaccggtgctttccaggaaacaggtgatggcctctggcaccgaaccttggcatgtggcgtcgaaccggtagtctgaacggattttgcccagtgatcggctcatgttatacccgtattcgtggatgatgtggtcttcgatccgttgtctgcatgcggcaggatcgtcggccagagacctctcatgctcaccgcggcagccgccgaagtagtatcgcgcgaggaagattgagtcggccactgccatccctcctctgacaccttcgggatcgtcgtgggtcaccgtgatcgagcgctcggcgagttcgcgacctccgatgggcatgaatccggtccgtgcggtgaatccgcagctcatcatccacgcacaaggcgatatgcgcatggccgatccgttgccgaaactgccgatgggctcacgactgtcggagaacagccagcgcatgaaccggggaccataacccgcgttcgggtacatgcgcccatatttcttcatcgcatcaatgaaatcatctgcgctaccaccattcatgatgccctcggctaccgcgcaggtcatcaccgtgtcgtcggtgaatcggcaaccattggagaacagcgggaaatgcttggttttgattggattggcttcgtatttcgagccgacgatatcgcctatgatcgcgccgaatatgccggtcattccatcctccatctgactcatgagctcctctgcacgatcttgtcgaatgcgtccattgccagcattccttgaacgatatgtgggcttccaccgaccggaagcgtacgttgaataagcaaatacatcaagcatatacctgagcgaagcgtctaatccgtgcgaaccagtcacggcatttggtgacggtcgcggaacaattatcggaagagaggcggtggcaatcgccggaccgcgcacatcttggtttcaagagcggcaaaatgccaagcccacaagtagcggtgcccaagggtagcggaaaaccggatattccgaatcccgctacgtggaggtggtcgagttttgccgctcttgaaaccaagatgttatggaggggacctccacttttccgcaaaacagagacgaatgacggccgataaatccgaaatcaaccatgccagaccgcgcggcgttggtcggccgcctgctccaaagtcaatggctgcggcagcaggtaatccttgccggttcgttccttgaggcaccgggcaacgagcacgaccaccataaacatttgctcatcatcggagagcatctcagaggtaacctggaaatattcccatccctcggcacggatcttcatggtccgctgggcatcccgtgcccattggtagcgatgatgacgcccatcgtattcgatgtcgatcttcgcctcagggtaggcaaggtccagaaacaccagtgaaccatcgcgcaagacgagttggtaattgacgcaagggattggcaggccatagcgaatcagtatcaaacgcaacatagtttccgcaaccgaatcggtaccttgtgccatcagcggcaacgccttccggcatttcataatgcctcgtggagcatacctatgattacgtctggcatactcatctacccaatcgaggaaatcgacgaaatcctgtatggtcatcatctcgtgaagtgtgtaccgacgcatcatggcatcgccgagcttcaccaactcctccaaatccagccattgggcgaacatcagccaggtgaatgcgcatgaggtgcaggtgacacctggggcgacttcgatcgtcttcagaggaattccgcttttgaagtaggtgacgctgaaccgaccgtaaacccttccatgccgtttgctggcgattctgtcttctggcttgagatccgacggacccaccacaacctgtagatattcaggtctcaaacgccgtcttgtcaccccagtcgtgagtggagtccaatccaaccccatgagcgccaatgccgtcgtgagcgcgaagacgcatgccacctgccgcccgcacacatcctcggcggctgcacagcgttgaacctctaagtcgcgtcgctctcgttgcagccctcgtgcctcgctggcactcgtctcgtccgaataccccatgcgtcgaccatatatggccggtgcatccgtgtaaatccactccactcgtcagtgtgtcgtcgcctagctctccctagggttgatcgaggtatgggaattacgggcatatcggtaatgcttgaattatactgacgcaggaaccgattgcagtaattgcaggaagaggcgaacatgggcgagaaccagacgacgaacagggcggtgagcgacgtcgtctttgatttctgcggcgtgctgatcgactggcaatgccatgcggcgctcgacggagtgtaccccgagcagctggtagcggacatctgtgcggacaacgatccgtatggtttcttccattacgaggatctcatggacggtggcgcggatttcgcggatgtgctcgaactggtgcgtgcggagcagggtgacgagatcgccgaagtgtaccgttattacatcgagcattatggcgatgcgttgccgcaattggtcgacggcgccgaggaactgctcaccgaactgtgcgaacaaggagtgcatgtctggggactgacgaactggtcggcggacacattccatttcgcgttcgagaagtacccgcagctccaacgattgctgagtggaaccgtggtgtctggcatagagaaactgcgcaagccgaacgccgacatctacgagcttgcacagtcccgcttcaatctggaaccgcagaccaccgtgttcttcgacgacacgcagcgcaacgtggacggcgcgaaatccgtgggctggcatgcattcagattcagcgacgtagcacaggcgagacgtgacctgctttcgctcgaacactgagcaaccgtttggacgggcgattcccgggcggtacactactcgttgacaacaacctcggggagaatcacatgacactgttgcagctgcggtacatcgtcaagattgtcgaatgcgggtcgatgaacgaggcgtcgcacgcactgtatgtttcgcaacctgcgttgagctcgtcggtcaaggaactcgagaacgagctcggcatagagatcttcacgcgctcctcgcagggcattgcgctgaccgtcgacggcgcggaattcctcacctatgcgcggcaggtgctcgaccaggcggatctgttggaggaacggtacaagaacgcgaaaccgcgcaagcagctgtgctccgtctccacacagcattacatgttcgcggtcgaggccttcgtcgagatgatcaactcgttcaaatcggatgaatacgagttcaccattcgcgagacacgaacgaaggacatcatcaatcaggtcgcgaacatgcgttccgagatcggcattctgtacctttccgactacaacacgcatgtgatcggcaagatgctgcgagagaagcacctcgagttccacccgcttttccgcgcgccattgcacgtgttcatctcgaaagacaacccgctgtcgatgaagaagaaagtgacgatggacgatctcaagcccttcccgttcatccagtacgagcagggggaggagggctccttcttcttcgccgaagaggcggtgtggccggagtattcgcccaagcagatcaatgtgaccgaccgtgcgaccattctgaacttcatcatcgggctcaacgggtacacggtgtgcaccggaatcgataatggcgacctcaataatgagaagatcatgacgattccgctcgacaccgacgagacgatgctgctgggctggatcacgaacgaacgcgcgaaactctcgaaggccgcacagacctatctcgacaagctcaaggaagtcattgcgaaccacgggtatacaatcatttcagattgacacctgcctacttcgcccacaccgaaagcacgtcgcgggcgcatatgagcaaacatatgcgcccgcgacgtgctttcggttacggatcactcacagtgcgtcgatcagatcgagcatctgactgacgttcttcttgccgaactcgacggtttgtctgcctccgcgattgagtacgatgcacggcacgctcatgacgtcatacttctccttgagttctgggaagtgggcgacgtcgtaggcttcggccctgacattcgggttcgccgctgcgatgcgctgggaggcacgaaccgtctccgggcacatcgtgcacgtcagactcaccaggatcatgatctcggtgggatcgtgaatcgcatcgattcgttcagcctcgtctccgatgagtggctggccggggcctgccgcattgtagaggccaagcacgaacgaatggaactcgtggccggtcggcacgccgtggaatgtcaagccggtaggcaccagcatccccgcatcgtcacgcaccatgatgctgaccagaggggcggcaaacggcagtgaatcgttcacatcgaattcgccacgcccgttgggggcgatcttgcccaccttgtcttcgatcatgtcgagcttgccgtcgctcaggcgcaccagttcagtgatgaacgccttgagatcggatgaggtcttcgtctcgtcgagctgcagctgcaatgtcagcggccgcgccatgcgcgagaagaccacattgagttgtttgatcacgtcgtcattgaacaccgcggacaccgtgttctgcggatcttccgactggctgcggtccggagccggggcaggggtggtgcccgcaggcttgttccgcgcagcctgctgctcctcctgctcatagacactatgatccacacgtttcggcacgatgcctgtctccagacttttcgcggcagcataccgttccgcattcaccgcggcgatggcaccatcggcggttgccgtgacgacctggcgcagatccttcacccgaagatcgcctgcggcgaatatgcccggccggctggtctgcatatgttcgtcggcaatcacatatccctgcggatcaaggtcgacgactcctttcaccacagcggtctgtggcacatatccggcgaatacgaacacgccgaaggtgcctccatcgtctggctgccagacggtttgcgtaccggtggcgaccgaacgccacacggccctgtcgagtccttgctcaccggcctgcaccccgacgagctcggtgccatagtgaatctcgatgttcgggttgtccttggccttctgtgccaccatggcatcgcaggtgaagtcgtcctcacgcaccagcaacgtcaccttgcgtgcgaagcgggtgaggaacaccgactcctcagctgcggcgaaaccgcctccgaccacaatgacgtccttgccggtgaagaactcgccatcacaagtggcgcaataggcgactcctcgaccggcatattcgagttcaccgtcgaaaccgattttgcgcggagcggcccccatggccagaatgaccgcgaagcaccggtaatcgcctcgcttcgtatgcacgatcttcaaaccggaacggtctggatcctcctcgatgccggtgacatcgccaacggtgagttcggcaccgaaatcctgcgcctgttggcgcatcgccttcgtgagtgcatggccattggtgcgcggtacaccagggtaattgaccacttccgccgtaatggtgatctgaccgccgaagtcctctttctcaatgacgagggtgcggtaacgtgcacgcgcgaggtacatgccggcggtgaggcctgcagggcccccaccgatcacaatcgcgtcatagagtttcgaatcgtccatgctccaatacgcttccgatcagagttcgcccacgaggtcgaggctcggctcgagcgtttcgtcgccgggctcccacttggccgggcatacctgatcgccatgctcgtacacgaactgcgacgccttcacacggcgcaggatctcctctgcattgcgcccgacgttcgaagagatgacctcataggccaccaccttgccctcggggtcgatgatgaaatcgccgcgttcggccaagccggactcctcgttataggtctccagatcacgggcgagcttgccggtggtgtcggcgagcatcgggtactgcaccttgccgatcttctcattggcatcatgccaagccttgtgcacccactgggtgtcgcacgacaccgagtagatctcacaaccggccttcttgaactcggcgtaatgatcctgcaggtcctcaagctcagtggggcagacgaaggaaaagtcggcagggtagaagaacagcaccgaccaatgaccgagtagatcctccttgcctatggtctcaagtgccccgtcatggtaggcctccacggagaaatcgatgagattatgctgcaacattgacatggtgatcttcctttcgatggattgccaaaagatccttcttcgagtatggccacatgcagcgtggattgtacgcgagtctactcagagcgaatgcggcgaacgtcacatatgatgtacctcacatgcggatcaaccttccatgcttcccaagtgacggaacgcctccggaaccgcgcggacgatgtcggaggcgatgatggggcgtccgagggattcgtcggcatcggtctcttccaatcccacgatgttcggtttgttccaagcatgttgggttgcatgagaggccagcgaggccgccagtccatgaaggtatgcggctgcggcagctgtttcgggaacggtggcgggatcttcgagataggcgtcaccttgctgggccaacaatgctccggtcatgcctgcgagcacgtcaccagcccctgcagtggccagggtggctggcgcccggccagacacgagcacgcgacccattgagtcatcatcgggtccaaccacaatggtcaacgcacccttgagcagcactgtggccccggtgagacgtgccgcacgtcgtgcgaaatacagggggcgttgttctatctcagctgcattcaccggttcgtcgatacgcgtcaggagtctggacagctcgttggcatggggcgtgagcacgacctgtgatggcacatgtcggggcagcaagtcaagggctccggcatccaccacgatcggaggcatgtttctggcctcctcgttctgctgggcatcgctgtattccacatcaccgccatcaatgtcgctcaccgattccgccggtgccggatcggtgagttcataatgtgccagcaacgattcaatggcctcccgttgaatgtcctgcgtgtcttcccccggaacaccactgcccaccacccaggcttcaacgcgtcccttacccattgtggcttcgggcaatgcctgcaacaccagatcctgggcatgttgtgggccgaggtagcgcaccatgcctatgttcgagcgggcagctgcggtggtggagagcactgcggcaccggggtattgcaccgatccggtgatgagccccaccacaccacgcgtgtatttcgagtcggtcaccttcggctcatgaatcgacatgcgggcgaaatcggcatccaccatctcaacgccaggcaccgcggattcgaggtcgaagccgaaatccaccagattgatctcaccgcaggcgtatgcggcaggggggagcatggcgcagggcttcagtgcaccgaacatcatcgtgatgtccgcgggaatgtaggcacccggcaatgtgccatcatccacgcctatgcccgagggcgtatcgaccgcaaccaccaacggcttgtgttcgctaccctcgtcgggcttgaaggcgccaagcacctctgcgagtgcgcggggaatgccctgcagggcatcgcgtacgcctatgccggtcattgcatcaacgatgatatgggagcgtttggcgtagcgaatggccgtctcaagtcgttgcccggcctctcccgaggagaatccggtgggtacgccgggaatgcgtgaacccggatcaagcgtccaaatgtggccgccggactgcacgaaagtgacgaacccctgttcatgcagctgcttgccgacggcaatggccgtcacgttcacgccctgtgccgcaagcatggcaccggtgaacaggccatctgcaccgttgtctcccgcgccgacaagcacgctgacccgtatgtcatgcgggtcaaggggagcgtcttctatgatctgcaggatcttgtgcgccgtggcgcgtgccgccatgcgcatgagaggcacgcccttcgccaacaggggttgctccatggcacgcacattggccacactgtaggcggtggtggtcagtaaatcgatgtgtgcgtcatcgagcgctgcggtctgctcgcgttgagcggtcagtgaggccataagacatcccttccgtatggtccataaaacaggacggcgaatagtctcaactctagtacgcggcgcaaggcggcatgcatgattgggcgatagcgtaacctgtttgcttcacctctcaacgaaaaatcgacatggacgaattccccgtccatagaattgggcatgacgcccatacggatttcaccgccgggcatatcggaaggaactgcaatgtgcacagccgttcgttttgacgatggacagaacaatatgtacttcggccgcaatctcgattggagcgaggattacggggagaaaatcgtattcgccccgcatgattaccattacgcgccggcattcaatgccgaagacaagaaccacccggtgatcggcatcggcatcatcgtggaagatacgccgctgtatttcgactgcatgaacgatgccggcctcgccgtggcgggtctcaacttcgccaagtactgcaagtacgccaccgaggcggtcaacttcaccacgaacgtggccgcatacgagttccccctgtgggtcacccgcaacttcaccagtgtggacgatgtacaggaggctctgaagaacgtgacgatcgtcggcaagcccatcaatgacaggttcccggtggccacactgcattggatcatcgccgacaacacccgcagcatcgtcgtcgaatgcaccgaggacggcatgcacgtctacgatgacgatgtcgatgtgctcaccaatcagccaccgttcccacagcagatcgagcatctcgacaattatgcctacgtttccccgcgtaccggcaagtcggtgaaatggggaagctcggaacttgagaccaatcaggattccaacagttcgcaggggcttccgggtggctatggttccatggcgcgcttcgtgcgcgcggcatacaacaatacgcattatccgacgcagagcggcgagaatgccaacgtgaaccgcctattcaagacgttgtcgaccgccgcagtgatcgaggggactgcaatctcggcgaacggcgaattcgagaaaacgctgttttctgactgctattcaacggccacgcaaaccgtgtatttgaagaagtacgacgatatggccgtgcattcctatgccgtcaaggatttcgacgcctcctcgaaccagttgcagagcaagtgagcgaggacgccagaggactccgttcggtaacgattgcctcgtagactgggacaacacgtattcgggacctgcgcatgcgtgggtcccgatttctatgccgagaaaggacagaggaacggcatgttcgaggaactgcataggaagatgaaccggttctggaatgccgatcgcacactgaacgagacggatcccgagttcattgggatcttcagcgaattcgcatatgacacggtggtcaatgagcccggtgccaatgatgagaagctcgacgaccatgcccgttgcatggcgatcatcgcagccatcatcggcgcacagggcatggatgccttcgagatgatgctgcctatctcatatcactccggcgtcacatccgttgaactcaaggaaatcgtgtatgaggccacgcctttgatcggcttcgcgcatacactgccgtatctcaaacgaatcaatgattatctcaatgtggagaatgtggaactgcccttggcgccgcaatccgcaatcgataagcaaaaccgcacacaagaaggtgcctcactgcgcagaacacttttcggcgaatctgcagacagtgacgaggagtttcgcaagatgggcgccggtcacatcgattcctggatcagcggcgattacctcggtgcctacctcacgcggaacggactgagcttgcaggaacgggagatgatcgcattctgcctgctcatggcacaaccggattgcgccaatgagctgcgcggccatatcatggcgaacctccgggtgggcaacaccgcgcatttcctcattgcagtggcttcgcaatgcctgccgtacatcgggtatccgcgcgcgatgaacgccgtgaaaaccattgcggaagtggcccatagtgacaaacagacagtgtgaccgaaccgcccgtgcggtcccacacctcgcaatcagtgaagaagtgagcaatgagtacatccacgcagaccgatatggcacaacctcggcatattccacccaaacaggacaatccaatcgtccaggaagagagaaagcatgagggcgcagccgtcaaggcggcgttggcggcgaatgtcggcgtggccatcgccaaactcgcggcctgggcattcacgcaatcctcggccatgctctccgaatcggtgcattcgatagcggactgcacgaatgagatcgtattgatggccggcggaagagtggcccgcaagaaacgcaagaacccgcaacacccctttggttggttccgcgtcaaatacttggcatcgttcgtcgtggcaaccttgctgttcttcgtgggcggcttcttctcgacaagcgaggccgtcaagaagatcaccgaagtgctctccgatcagtcggcacgagtggcgaaccggggtgagctcgtggttgcgctgatcgtcgtggtcatcagcgcctgccttgaggggtatggtctgcaccagtcggtcaaagagtccaatgaacgcatgcggcataccggtatgccgcatatgggcatctatcggttctggagagtgacgaaatccgccgacctcgcctcggtgatcatggaagacacgctcgcattgatcggtctggtgttcgccttcctcggcataggactcgcgatctgcaccggtgacgaactgtacgatgcgcttggcggcatgttcgtaggcatcgtgttgattgtcggttcgctgctcctcgcctacaagaccggttcgctgctcataggggagtcggtgagcccgttgacgcaggagcggatcatcaaagcggtcgaggggaccgagggcgtggaggatctcctcaacatgcagagcgtgcatatgtcggaagacaacattctgctctgcctcaaagtgcagacctccaagttcgaccgtgattacgatgtgacgacggtgaacaagatcgaggatgcggtgcgtaccgcgatgccatggtataactgggaaatctatgtggaacccgatatgatgcgagagacgcaggcagggacgccggacgaaccggttgatctcatggaatagcaatctcgttcctcgaatatcatagtggcccgaactttcgtccgggccactatgatattcgaatcctgattgcgcacgcaaacaacgccgcaacacatcccatcgccttcactcctcggcgacaagctctagatacgaatcgttccacagatcctcgtcaccatccggcatgagcagcacgcgctctggtcggagcgcctcgacggcgccctcatcgtgggtgaccagcacaatcgctccctcgtatttcgagattgccttgagaatctcattgcgcgaggcgggatcgagattgttcgtgggttcgtcgagcagcagcacattggcacgggaggtcaccaacgtggcgagcgccagtctggtcttctcgccgcccgaaagcacgtgggtgggtttgaaggcatcgtcaccggagaacaggaacgatccgagtatggagcgcgcttgggtgtcggtgagttcgggtgccactcgctgcagattctcgagcacggtgatgcctagatccagggtgtcgtgctcctgggcgaaatagccaattttcgcgccatggccatattcgaccacgccggtgtccggctcctcgagatgggcgagcaaacgcagtgtggtggtcttgcccgcaccgttgtacccgaggatgaccacccgggagcctttgtcgatggccagattgactcccgcgaatacgatgttcgagccataggctttcgagatgtccttcgcctcgatgggggtcttgccgcatggtgccggctccgggaagcgtatgtcggccaccttctccttcttctgggccacggaggtttcggcgaggagacgttcagcccgacgcatcatgttctgcgctgccacggcttttgtggctttggcatgcagtcgaatgccctgctgcatgaggcgctcggccttcttctcagccacttcacgctcacggcgacggcgctcctcgtccacgacgcgctggtgtaggtatgccttccaaccgagcgagtacatgtcgatctggccgagctgggcgtcgaggtgccatactttgttcaccacctcgtcgagcagttcgttggagtgggagatcacgaggaatccgccttcgtatttcttcaggaattcgcgcaaccacagtatggaatcggcatccagatggttcgtcggttcgtccaggatgagtgtgtcggcatcggagaagaggatgcgtgccagttctatgcgccggcgttgtccgccggagagcgtgccgagttgttggcccatgacctcctggggtaggccgaggctggcggccattgcggtcgcctccgattgcgccgcatacccgccggctttctcgaaatcctgcatcgccttgtcgtaccggttcatcgccttcgtcatcacgtcgggatccgggctggtcatctccttctcggccttgcggattcgtttgatgatcgaggcgatgtcacgtgcgctcatcatacggtcgagcgccgtctgttccggatcggcggcatgggtgtcctgcggaaggtagccgagtttgcccgagacacgaacggtgcccgcggtggggagcatgtctccggtgatgacgcgggtgagtgtggtcttgcctgcgccgtttcggcccaccaggccgatcttgtcacccttcgtcacatggaagttcgtcgggtgcagcagcgtgcgggcaccgatctgaatctcaagtccctgcgcgtcaatcggcatgggtcaccatctcctgtatgaactctcgtatgtcttgtatctccggggcgacgatcgcatgcgccgtctgcgggtagtcccggtatgtcagcctgccggtccgctgcaggcattcgcggagcctgcattggtcggcccgcggaatcgtcgtgtcatcctcgccatagcatagtaagaaacgtgtacggctgtgcatgagccgctctcgctcgtcatcggataatccgccgacgaaggaggggctcatcaatatggcggcatcgaacatcgtgggctccgcaagcaccatacgtagactcatatagccaccttgggagaacccgatgcagacggttggacgattgcggcagatgggggagtcgagcaaccgcctgattcccccgatgctttcatctgccaaccgtctgcgcgcctcggggccgcatccatgcgggtaccacgaatagccgcccatgtattcgcgctcgaatggggcgcggaaactgatgtagctcatcgggtcgtgcctgccaacggcctcaatgacgcggatcatttcatgctcgtcgtttccgtacccgtggaacatgaggaacagcggcgaggaatcgtcgtggacatggcaaagggcgttgagcatatcaggctccttgggtcttcttattcctacgtcgtcaaccggcagatgaaccggaatcagtcgaaaatgcgctctcgatatatgtcgacaagttggtcgagtgtcttcgatgcatatgcgggggaagtggagggaagagccgtttcagatacatggatgccattgcactcgagcatcggctcgctgtatttgtggaacagctggtccgccttctgcccgcacgcgtagatatgcgagatctgtgaattgcgaatgatctcgctcaagtcgctgggcacgacgttgcggatgctcgaatcgctggcgccgacgatatcgcatgattccacggtgtcccacaacgcgaaccggtgacgcagcgcgaatgcccggcgcgaatccggagtgtcgccaaccacgtcggaggcatcttgcggatcggcgaacaacgcctgcatgatcggccagaaccggttgcgcggatgcatgtagaagaagccggcttcccgtgatttcgggctcgccatggtgccaaggaacaagcgggtagaatccgccgcatagcagggtccgaaaccgtgctccacatgaatgaatcgttccatagtgctcacctcatacacaacagccgcgtacccgggaaattccggtacgcggctgcgctgactcacagacggcgtgatgaaagcctcacctatgctcctgggcgcctgggtaatccgtcgattgcggttctccgtcggattccacgctcttccgtccttgctcatccaccgcacccgcatgtgccgaggagagcgcgtccacggaattgagccttccggtcagatgacgccatggcagatacatgagtgcggcggcgatgctctcggcgatgatgacaatcaccgcggtgatcttcgaagtgtccatgattcgaatcgccactccgagcacggaccacaacacgcacagcccgaacacccaatcacccatgtaccagcgcatggcgcaggcgacggccagcaacagcaaagccaggatgatagtggaaatcatctgtccgaacgcagaaagcgaaccgtctttggacaggtagtagctcactgcgcgggcgatgtcggtgatggtctcgattcccagccatgaaccccaaagcgagaacggcacccagccccatagcgttctgtcatgtctccgggagaagaaccatagcacccagatcactatggtcgaggcaaacaccaacgtgatcgtggccgggtagttcacggcatggaagcagaacagccacgcaatctgcagtacacaggcggcaatgaacaggattccgaggagactggccgggatcttgcccagattcctcgcgcggtgcttatcgttgccgagacgcacaagccaaacggcggcgaatacgaatatgaccgcccagatgagatccgtatatcgcgccggcacgaaccaagtgaacgcctccgaatgctgcggcttgaccatacggcccatcaccccggtctgtgccagcacgttgcacacgaccaatgcggcgaacgacacccacgcacagatcatctcaatgtcatgccgcaccttctgttttgaacgctgcgaactgcttttcggctccacggtcaccgcattggcctgcgtatgctctgtctgtctcttctcgcccatcagctctcccagatacgagtgaatgcatgtgtatgactctacgatatcgccagctggcgcacatgttcggcatgagcatcgaattcagtcaaccgggaaaacccgacgatggaatatggggcgacggcatatgttgttatttgggtggctgcggcacacgtcccacaatcgaacaagtgttcgacttttgtgtggaattgatgtacgatactgcatacacataagccgatcgcatacagacggcgtggaaagagcgatgcctgacgggaggaatgccttggcaaatcatgatgcacgggcgagcaggaaaacggtcgtggaaaaggtgatgacgagcgactcgttcctgagcagggagctcggcaaggcgcccctcgaggaacacgatggcaatctggtggccgacatcggccacttgcccaatgatctcaaaatcatggtgcagggtgcccgcgagcacaacctcaaggatgtggatctggaattcccccgaaaccgcatggtcgtgttcacaggcctgtcggggtccggcaagtcatcgatggctttcgacacgttgttcgcggagggccagcgcaggtatgtcgaatcgctttccgcctatgcccgccagttcctcgggcagatggacaaaccggatgtcgatttcatcgagggtctgagcccggcggtctccatcgaccagaaaacgaccaaccgcaacccacgttccacggtgggaacgattaccgagatctacgattacctgcgtctgctgttcgccagaaccggcataccgcactgcccggtgtgcggcgaaccagtgcaggcccagaccccccagcagatggtggatgcactgctcgcataccccgagcgaacccgcttccagattctggcgccagttgtgcgagggcgaaaaggggaattcaccgatctgcttgaactgctgcgtggcgatgggtacgcgagggccatcatagacggcgagatgcggcagctgtccgacgacatcacgctgactaagcagaagaagcatacgatctcggttgtcatcgaccgtttggtgattcgtgacggcattcgccagcgtcttacggattccgtcgagactgcgctgcgattggcccatggggtgatggtcgccgaattcgtcgacctgccgcaggacgatccgaaaaggcaggtgccgttctccgagcatatggcctgcccgaatggccataccctcgatctcgacgagatcgagccgcgcacgttctcgttcaatgcgccctatggtgcatgtccggaatgcacgggtctcggtttcagcttggagatcgaccccgaactcgttgttcccgaccccgacaagacgttgaacgagggagctatagaaccttggatgatgacgaagagcagcggcgactattaccgccacctgcttgaaggactcgccgatcagatggggttcagtctcgataccccatggaaggacctccccgaggaggtgcgccagtcaatcctatacggccgcgacttcaaggttgaggtctcgtatcgtaaccggtggggacgtatgcgcgagtacaccaccggcttcgaaggtgtgatacgatccctcatgcggcggcacgaggagaccgattccgaacaacgcaaacaatactatgaatcgtacatgcgcgaagtgccctgcagcgcctgccatggcaagcgacttcgaccggaggtgctggccatcaccgtcgacggggaatcaatcgccgatgtgtgtgacatggcggccgagcgcagcctcgaatggatcaacaacctctcactgaccggagctgcggcgaaaattgcgggtgaggtggtcaaggagattcgagcacgcctcggattcctcaacgatgtcggcctgaactacctcactctttcccgtgccgccaaaacgctgtctggaggcgaagcccagcgcattcgactggcgacccaaatcggctccggactcgtgggcgtcatgtacgtactcgacgagccgtcaatcggcctgcatcagcgagacaacgcccggctcatctccacattgcatcatcttcgcgacctcggcaacacactcgtggtggtcgaacatgatgaggatacgatcacaagcgccgattgggtggtggacatcggcccgaaggccggcgaacaaggcggggaggtcgtgtattccggccccgccgaacaccttgtcgacgcgccgaggtcgatcaccggcgactacattgcggggcgtcgcagcatcgaagtgccgaagacacggcgcaagatagatcgttcacgtatgctgaaggtggtgggcgcccgtgagaacaatctgaagaacatcgacgtcaggtttcccctcggcgtgatgacctgcgtgaccggcgtctccggatccggcaaatcgacgctcgtgaatcagattctctacccggtgctggccgacaagctcaacggtgcccgcatcgtgcccggcaagcatacgcgtgtcgagggtgtggaccagtgcgacaaggtgattcatgtagaccagaacccgatcggacgcaccccccgttcgaatccggcgacctacaccggcgtatgggataaaatccgcgccctgttcgccaagactcccgaggcgcaggttcgtggctacggtcccggacggttctccttcaacgtcaagggcggccgttgcgaagcctgtcacggtgacggcaccttgaagatcgagatgaacttccttccggatgtctatgtggaatgcgaggaatgccacggcaaacgctataatcgcgaaacactcgaggtgaagtacaacggcaagaccgtcagcgacatcctcgacatgccgatcagcgaggccgccaagttcttcaaggcgtacccctccatctcacgctaccttgacacactggtggacgtcggactggggtatatccgtctcggacagccagccaccacgttgtcgggtggcgaatcccaacgcgtgaagctggccaccgagctgcaacgacgttccaccggcaagacggtctacattctcgacgaaccaaccactggcctgcacttcgaagacgtaaacaagttgctgctggtgctgcagggactcgtcgacaaaggtaacacggtgatcatcatcgagcacaacctcgatgtggtgaagtcctgcgactggatcatcgaccttggtcccgagggcggcgatggaggcggcacgatcgtcgccgagggaacgccagagcatctggtcacatgcgaaaggtcttggacaggcagattccttgcaccgatgctcgaacgggcatcgagcgacatgcaccaataacacattgccacacctcacgcactgtcggcaatcactcacggcaacaagcgataaggggagacatgcctattttcgagcgccatgcgccaggaacctggaggcatcttgccgatgatctcatggaagtcaccggcaataccggtgccggcggtcatgcacagccgccagaggacgtgaatgcgaacggcgcaccgctgctcggcgactcccgtgatctcttcagacccaagacgggtgacattcctgcccagcccggcgtctataagtggcgcgatggcgacgggcaggtgatctatgtgggcaaggccaagaacctgcgcaaccgtctatccaactatttccagccattgcggcagctgcacccgcgcacccagaccatggtgctcacagcccgatccttggaatggacggtggtgggcaccgaattggaggcgctcacactggagtacacctggatcaaagagtttgatccacggttcaacgtgcagttcagggacgacaagacctacccatatctggcgctgtcgataggcgaggagtacccgcgtatttgggtcacgcgcagccgcaagcgccgtgacacccgctactatgggccatatgcgaaagtgtgggatctgcgcaaaagtctcgacggacttctacgcaccttcccggtgcgcacgtgcaccgatgcgaatttccgcaaggcgcaactcaccaataggccatgcctgttggcgtcgataggcaaatgctctgccccctgcgtggggcgcataaccccacaggaccacaagcgcctgtgtgagcaattggtcggcgtgcttaccggaggcataggcaaatcgtatgtggcgaaactcactgcggctatgaaggaggcaagcgccgaactcgatttcgaaaaagccgcgcgccttagagatgagatccagatgctctccacggttgtggagcagaatgcggttgttctcgatcaggatgtggatgccgatgtgttcggcattgcatccgatgaacttgaggcgtcagtgcatgcattcttcgtgcgctcgggctcgattcgaggcgaacgcaactggagtgtggaacgcatcgaagatgtcgatgacgctgaactgatcagcgatctgatcatgcaggtgtattcggaactgtacagtgagcgtgaagcgggggaattccgcaggactgatgcaccaccatcctccagacccaccgtggaaccgccaatagcccaggcagcgacgcttgacgcggccgtgagcgcggaacccacgcccattcgcatggaaaaagcacagatcaaagtcgaggaacagcgcacggccatgggatcgacacagcgcatgtcggccggcgacgcgtcatcccgcgcacagtcgaccaaggcacgtaacgcaagacgcgagcatactggtcgtgccgatctgctcgaaccgatcgcccctgtgcccagacaggtgctggtgtcggtgatgcctgcgcgtgccgatgacctggaacaatacttgcgacggcttcgcggtggcgcggtctcgattgggacgcctgcaaggggtaacaagaggcaactgctcgaacgcgccgaacagaacgcacagcaggcgttgcaacgttcgaaaatgagccgcatctccgacataagtgcgcgtacgaccgccatgaacgatgtggccgatgcgcttggactcagccaggcgccgttgcgcatcgaatgctatgacatctcgaatacggtgggcggggcgttccaagtggcatccatggtggtgttcgaagacggcatggcccggaaatccgaataccgacgctttgccatacgtggtgccgacggaaaaggtgcggtggacgatctcaatgcgctgtatgagacgctgaccagacgattcaagcatgggaacattgcgggagacaccggcgaaagcatggacaacgagaagcgggcttcgcaggagggagagcttgaatccgccgagcaggtccaacaggaaatagtccagcagaacaccgatcgccgtcatttcgcctacaaaccgaatctggtggtggtcgatggcggcaagcctcaggtgatggccgccgcgaaagcattggaggactgcggtgtgactgatgtggccgtgtgtggcctagccaagcgcatggaagaggtgtgggtgccggacgacgactatccagtcattctcaaacgttcatcggagggcatgtacctgcttcaacgtgtccgcgatgaatcacatcggttcgccatcaactaccatcgtcagaccagacgcaagggtgccctccgttcggcactcgatgagattccgggaatcggcccaacgttccaaaaacggctgctaaaccacttcgggtcagtgcgccgcatgagacaagccagcctcgaagaactggaatccgtgaaaggcgttggccacgccaaagcacgggccatctacgaagcactgcatgacaatgcttcgtgaccacttatatgcgctattgcaatggctatgagtcgtgttgtggcatgcgccgatgccgcaataaagcatagttatgctgtagagtgctgtagggcatgcaacgggcatgcacaaatgaggggatgagaatatgaatgagatgcaacgatgtgcggtattaggcaaaccaatcgcacattcgctgtcaccggtgttgcatgaggctgcgtatcgagcgctgggtcttggacaatggtcgtatacgaagcaggaagtggctgaaagcgaacttccctcattcctcgcctccctggacccctcctggcgaggcttgagcctgacgatgccgctcaaacgcaccatcgcccccttcggtatcgcacggaaccaatgggcacgggagcttggcgtcgccaacaccgtcgtgttcgattgggattccccctcgacctcagcgggtcgggatcttccggccatggcactttacaacactgatgtctatggtattgtgcgtgctttccatgatgcctttcgcacccatgtcatgacgttgccagctcaaccacacgcagtcatactcggcaacggcaacaccgcgacttcggcattggcggcgtgcatcacgatgggctgttcccagatcactgtcgccgcacggcatccgaatcgcagcacggcactgatcgagctgggtgccgcgcatggtgtgacggttcgtagcatctccttggaggattgccttccagcactggaacaatgcaacatcgccatcagtacgattcccggaacgggcgccgatgtggttgcccggcatttcgcggagcatgcacaacccatccatggggcattgctcgatgtcgtatacgatccccgtccgaccgaactcatggtggcctggcgcgatcgtggcggcctcaccataggaggagagcggatgctgctacatcaggccgtggcgcaagtgttgctgatgacgggaataatcgggggtgccgatgtggatgatgccctgaataatccaccccaaaccggtacactggaacaggccatgtgggaagcgttggagaaggagttgtgatgcagtccgcacgcaatgaacaaagaggcacgggaccagaatcaccgcatgcagcctctcctacggaaggctttgaagtgctgctcatcaccggcatgagcggcgccggtcgttcgcacgcagcccatagcatagaggacatggggtggtatgtggtagacaacatgccacccaaactcctcgaacccatggtggacatgatgactgcgtcgaaatccgggtttcataagcttgcagcagtgatcgacgtgcgctcccgcgactatttcatggacctgagttcggtgctctcgcatctggatgatctgggcctcaaaacgcgcatcctcttcctagatgccgatgacaacgtattggtcaagcgattcgaatccgtccgccggccgcaccctttgcagcagggtaaccgtcttatcgacggcatccacgaagagcggagactgctcgagaacctcgaggaacgtgccgacatcgtgatcaacacctcgaaactgagcatccaccagctctccaccaagctttacgaggctttgacaggcaacggacccacaaccgtttccgtgcacatcttcagtttcggtttcaagtacggcataccgatcgatgccgatttcgtggccgatgtgcggttcctgcccaatccctactgggtgccacagctacgagagctcaacggacatgatgcaccggtgagcgaatacgtgctgtcgaatgacaaggccacacagttcctcgatgcctatgagaaggccatcgaaatagcgatccaaggctatgcacaggaggacaagcattatgtgacgatcgcaatcggttgcaccggcggccagcatcgttccgtggcgatgagcgaggcattggcatcaagattgcggtcgcatggcctctcggtctccgtctcggcccgagagttggatcggaaaacccaatgattgcaagtggtttcccatatcgtgaaagcaacttcaacatgtgggaaaactcaacaaagatgtccaagacgttcggtatcacagaacagcggagtcaatgagacacgccgaaccgtaataggtaccacacaacttacaggaggatcttttggcgcttctcgatgaggtcaaaagcgagttgtcgaacatcgatgggggatccccggcggtgcagaaggcacaggtgacgtcgatgctgtacttcggccgaggattccgcaaggtgcagcgtgaatcctcgacgcagatcatcgtccaaccacaattcgactccatggaagccgcccactggctccaggaaacaatcgagagcctgtataaaatcccagccgccctcaaatccgtcgatgtgaagacccctcagggctccatgcgtcgatatgccgtggacgtcggcgcacgcgccggtttcgcattggcggtgcgcaccggcatgatagacccacggctcaaccgtatcgtccgcggactgccaacggatctgtccaacggcaacattgcccaaatcaagggtgtgtggcgcggtgccttcatgtctgctggtgtgctttcggatcccgacaaacccagcgcgcttgagattatctgtccgaacgaggagacagcggattcgctcatcgccatgggtcagcgcctcggcatacgagccgcaaagcatacggtgcgcagttccgtacgcgtccatctctccgacccggatgccatcgaacggctcctcacgatgatgggagcctcaagcaccgtacgcgattggaccggcaagagacccgacaccgaatcacaccatcgcgccaaccgactggcaaacttcgatgacgcaaatatgcgacgcagtgcgaaagccgccgccgaggccgtggtgaaagtgcagcatgcattcgatgtgctcggagacgatattccgcagaatcttcgtgccgccgggcaattgcgcatcgatcaccccgatttctccttggaggagctcggacgagccgcacgcccgcaaatcagcaaggacgcggtggcaggtcgcatccgtcgtctgctgcaacgggcggagaaagcggagcaggacgccgcaatggcgtaagctggtgtaaggcgtgatgttgcgtaacggataatcgaaccgatatcgcgtggatttgacgctagaatgcaagggatggcataagccacacccgcattcttgcggttagaaaggataacgaatgaagacactcaaggatcttggagatctgaagggcaagcgcgttctggttcgcgcagatttcaacgttccgctggatgggactacgatcaccgacgatggtcgtatcaaggcggcgctgcctaccatcgaggctctgcgcaaggaaggcgccaaggtcattctcatggcccatctcggccgcccgaagggcaaggttgttccggagctttccttggctcccgtggctgcacgcttgagcgaacttctcggtgttcctgtggttctcgcctccgacacctatggcgaggacgcccaggctaaggtagccgccatgaaggacggcgacgttgtgctgctggaaaacgttcgtttcaaccctgaggagaccagcaaggacgaggccgagcgtgccgcatacgccaagaagcttgcggctctcggcgatgtgttcgtctccgacggctttggtgtggttcatcgcgcacagggttccgattacgatgtcgctgccgacctgccggccgccgctggcttgctggtggagaaggaagtcaacgccctctccaaggcgaccgaggatccggaacgtccgttcaccgttgtgctcggtggctccaaggtctccgataagctcggagtgatcgagaaccttctcgacaaggccgatcgtctcgtcattggcggcggcatggtgttcaccttcctcaaggccaagggttacgaagtcggtacctccctgctggaagaggatatgatcgaccaggtcaagggctacatcgaaaccgccgacaagaacggcgtcgaactggtgcttcccgttgacatcgtcgtgaacaagggcttcccggctggtgacactccggtcgatccgaaggtggttcccgccgatcagattccgtctgacatgatgggcctcgacatcggacctgagtcatgcaagctgttccacgacaagatcgtcgattccaagacggtcgtatggaacggcccgatgggcgtcttcgaggttcctgccttcgcggcaggcaccaaggccgtcgcccaggctctggtggatgccaccgaacatggtgccttcaccatcgtcggcggtggtgattccgctgcggccgtgcgtcagctcggattccccgaagatggcttctcgcacatctccacgggcggcggcgcctctctcgaattcctcgagggcaaggagcttcctggcctcaaggtcctcgagtagggattcacaacactagcccaataacggtgtgacgtggcgcccggcaataggtactgggcgccacgttctcatatggaggacaggcaaggcaatatggcatcgacacgacgcatccccatggttgcgggcaattggaagatgaacttcgatcatcttgaggcgaccgagttcgtccgggcattctccaagaacctcaaacgatgccattttgacttcaatcgttgcgaagtggcgctcttcccgtcattcacctcgattcgtagcgttcaggtgatggtggaatccgaacacttgcgcatcagatacggggcccaggccgtttcggtcacgtcacagggggcgttcaccggtgacgtctctgcggacatgctcgcgcatctgggttgcagctatgtgattgtaggccattcggaacggcgcaaataccatccggaggacgatgcgaacatcgtcgatcaggtacgagcggtgcttgccgccggcatgcagccaatcctatgcgtcggcgagagtctggaggagaggcgaaagggcattgaacttgagtttgccgtcggacaggtgcatgacgtgacacgcgacctttccgatggggaggcatcaaaactcatcatcgcctatgaacccgtctgggcgattggcacgggcatggttgctacaccgcagacagcgcaggacgccgcccatgccttccgcgtggatctggcgaaatcattcggcgaccatgtggcgcagaccgtgcgtgtactgtatggaggctcggtgtcttcgaagaactgtgtggagctgattgaggagccggacgtcgacggcttcctcatcggaggtgccgccctcgacgtcgatgagctcaccacaatctgcaggaagacgattgcgacaacatcttcacatgataatagttgattttgcacgctttttcgcgaacttgcggtacactggacaacggtattgaaatttggaggttcacccgtgactgtagtcaagctgattctgcagattgtgctggttgtgctcagtctgctgcttaccctgctcatcctcatgcacaaaggcaagggcggcggcctgtccgacatgttcggcggcggccttacgcagaacgccggttcctctggcgttgccgagaagaacctgaaccgttggactgtgatcatcgcactcatctgggttgccatcatcattgcgctcggactgttcaccaagttcggtgtcgcctgatatgagtttgtgaaaggacccatgctcctccctaggagggcatgggtcctttcgtttttgttatacaacagcatatgatccacgaacaggggagtggacttgacggaaccattcattgtcgccgatctggacggcacattgctccatgacggcaagaccttcgaacaacgcgcattgtcggactacacgattcacactgttgacacattgcatcgcaaccatgttccgtttgtcgtggccaccgcacgtccagtcagcacaggtctcgacatggtacgccgattgcatgccgatgcatgcatctatctcaatggcgcactcatcgacttccatccggcgacctctgattacgcgatgctcaccggaaccaaatctactcccaacgggcaactgttgaaaataggcttctcttcagactatgcctgcgaggtgtgccgatcaatcgcgcatgtgattcccgacatcgagataggcatcgtcatggatgacgtacgatatacgaatttcgatgtgtctaagtactggaagacacagacgtggcgattcaccgatttcaccgacgtcccagagggcaccgcagacaagatcatcatcttcccaaccaacgagcagactccgttgctcagcacattgcttcctgacgaactgtcgctcaacatcagcgagggaagtctgtggatgctcatggatccacatgcgaacaaacagtacaccatggaactgctgtgcgaccgctggaacatcgatttgaacaatgtggtcgcatttggcgatgacatcatcgacattgacatgatgcagcgtgcgggaaccggagtggccgtcgccaattcgaatccgaaagtattgaacatagccgatgagatatgtgcttcgaataacgatgacggcgtggcgaaatggattgaacaccgcatattcataaattgatcttgaacttctgtattttgaacactgaaatgttcaagtcaaaactatgttcaaccgttacggtacgcttcgaagaaacacttatgttctaagttcaacggagggacggcatgaccgatttcaccacgcgcctcaatcaggcgatggagttgcgcaacatcaagcagatcgacttcgtcaaagcggcgcaggaccatggagtcaagctggggcgcagccacatcagtcaatatgtgagcggcaaaacaagaccgcgccgcgatattgagcgattcctcgcggctgtgttgcgggtgaacgcggattggctggcaggcgagagcgtgccgttcgacgatgatcctgaaaccttcgcaaagattgaacacgtgagtccagacgccgattttgaacatatcaagagagttgaacagaatagttcgattcagaattctgaacatattgaacataacaatgaactcgctgaaattgaacaggagcaagacatggaagcggcagcgaacaataatgtgcaggacccctcgttccctgatgtgccatcaagtgtcacatcggaacccatgaacatcggctcccgacgggtcttcaccaagtcacataaactggacaacgtgctctatgacgtacgcggaccggtggtcaacgaggcggcgcgcatggaagcagccggcatgcatgtgatgaaactcaatataggcaatccagccccattcggattccgtacaccggacgaagtcgtctatgacatggcacaacagctcaccgatacggaagggtattcggcgtcaaaggggctcttctcagcccgtaaggcgatcatgcagtacgctcagctcaagaacctgccgaatgtgggagtagaagacatctacactggcaacggtgtgagcgagctcatcaacctcagcatgagtgcgttgttggacgacggggacgaagtgctgctaccggcccccgactatccgttgtggacggcatgcgtcaccctggcaggcggcaaaccagtgcattacgtctgcgacgaacagtcggagtggtatccggacatcgacgatatgcgtgccaagatcaccgatcgcaccaaggcaatcgtcatcatcaacccgaacaatccgacaggcgcgctctatccgaccgaggtgctgcagcagatcgtcgaactggcgcggcagcaccagcttatgatcttctccgacgagatctatgaccgcctcgtcatggatgggctcacccacacgtcaatcgcctccctcgcccccgacctgttctgcgtgacctatagcggtttgtcgaagtctcatatgatcgccgggtaccgcatcggctggatgatcctgtcaggcaacaagtcgatcgcgaaggattacatcgaaggccttgacatgctcacgaacatgcgcatctgctcgaatgtacccgcccaatcaatcgtgcagacggcattgggaggccatcagagtgtcaacgactacctcgttccggggggccgtatatacgaacagcgtgaatacatctacaacgcgctgaactcaatcgatggcatcacggcggtcaaaccgaaggcggccttctacatcttcccgaaaatcgatgcgaagaaattcaacattcgcaacgacgagcaattcgcgctcgatctgctgcacgacgagaaactgctcatcgtgcagggcaccggtttcaattggaaggacccggaccatttccgtgtggtctacctgccgcgcgtcgaggtgctcaaaggcgccgtcgacaaaatgacacacttcttcagccactatcgccaataggcgcatgcatggcttggcgaacaacagggaatgcggaaaggatgacaggagacatggccgaggggaacatcagcgcgaacgatcaggcgatactcgaactgctcgagaacgatgcgcggctcgatgcacgggatctggcggacattctgggcgaggaggcacaagaggtgcagcaggccgtccgccgcatggaggagcagaagatcatctgcggttaccatacggtgatcaactacaacaaggtgctgcgtgacgaacgcatcatggcgttcattgaggtggaagtcagcccgatgaaaggcaagggctacgaccataccgcggcgttgctcgcaaaataccccgagattgattcgctctacctgatcaccggcgacaacgacttcatctgcctggtgcagggcaagacgatgttcgaagtgtgccaatttgtggccgatcgcatcgccgtcatggagaacgtgcagagcacgaaaacgttgttcgtgctcaagcagtacaaacaatccggcatactcaccggcgccggtcggccgaaccgtgccgaggaccgtctggtggtgagctactgatgaagccgatcaaccagaccatcgcgcatctcaaaccgagcggcattcgcaaatacttcgatctggcgaactccatggagggtgtgatctcgctcggtgtgggggagccggacttcgacacaccgtggcatatcagcgcgaaagcagtggagtccttcgaagacggccatacgcactacaccgcgaaccggggactcatcgccctgcgcaagcaaatcgcagggtattaccacagccgctacggcatcgactacgacccgcaatccgagattctcgtgactgtcggtggttcggaagcggtggatctatgttgccggacgttgatcagtcccggcgacgaggtgattgtgctggacccgaactacgtggcttatgagccggcgatcctgatggcgggtggggtgccagtgcgtattgagctcacgcaagacaacgatttcaaattactgccggaggacctcgaacgcgcgatcaacgaccataccaaggcaatcattctcaacttcccgtcgaacccgaccggtggcgtgatgacccgcgaggactacgagcgtgtggttccaatcctcaaggaatccggaatctacgtcatctccgacgagatctattccgaactgctgttcgagggagaattctgctcacctgccaacttcgagcagattcgcgatcaggtgctcgtcatcaacggcttttcaaaggccttcgccatgaccggttggcgcctcggttacctgctgagcaacgcggatctgagccaacagctcaccaaagtgcaccagttcgtcatcatgtccgcacccacatcggcacagtatgcggcgattgaggcgcttgaacacggcattgccgataccgagtcgatgcgcagggaatatgaatcgcggcgcaacctcatctgtgccaggctcaaccgtatgggactgacgacgaatgtaccgaaaggcacgttctacgtgttcacgaacatcacatcctcaggcctcacctcagacgagttctgcgtgcgcctgctggaggagcacaaggtggccatcgtccccggcactgccttcggcgattccggggaaggcttcgtacgcatttcgtatgcaacgagcatggagaacatcaaagaggcctgctcacgtatcgaggcgttcctcgaatcattgcatctgccgagtgaatctgtggactctcaccatggcagccattcgtgacactcagcctccccgccttcccaaattcccgatgggcggggaagggctcattgaatcgcggctctcgttgcttactgccgaggacgatcaggattcacgccgcttcttcgaccagcaggcctccacgatcgatatgaccgccgctgcgttgctcaattgcgagttcaggaatctcgcaattgacacaatcattgccgagcgcacacatgttaatcatgtgcttgtggattcctgccgcactgcgttgctcggcatccgcagcatcggcatggaaaacagcattgcggtccactgctccttcggtgccgttcaggcgaacacggcgaagatcattggcatggagattcgtggatgccgcatcgactatctcaattgcagagatgccatatgccgtgacatcatgttccgcgattgcgagataggggagctggacggcaacgatgccaagttctcgcgcatcgcattcgctgggacacgaatagacgtgctctccttgcagcatgccatatgtgccgatgtggatttgcgtggcgcgcggctacgggagattcgcaatgtcgattcactgcatgggaccaccatgtctttggagcagatcgccgacctttccgaggtgttcgcacgaagcatcggcatccgcacacagtgatcgattgccttcgatgcatatagaaaatgggcccagcgaatgctgggcccatccgattatgtcttgactagaccaagtcagtcgaaatcagccgttgacacggtcgatgccggactggacatcggtgagcaccgaatcccaggacttgatgaaggcggcgacaccatcggcctcgagcttgtcggtgacatccttgaagttgatgccaacctcggcgaggtcgttcatgatgtcgtgggcttcgtcatagttgcccgggatgatgcccagcgtggcctggccgtgatcggccacagcgagcagggtcttctcaggcatcgtgttgacgacgtccttggcgacgagctcatcgacatacttgacgtcggagtaagcggcgttcttggtgccggtggaggcccacagcggacgctgcttcttggcgcccttggcttccagagcagcccagcgcggatcctcggcgaacttcttctcgaagagctcgtatgcgaggcgagcgttggccacagcggccttgccttcgagacccttggcctcgagggagccaatctcctcgagcttcttgtcgaccgcggtatcgacacgggagacgaagaaggatgcgacggaagccatcttggacagatccttgccattggcgtcggcctgaaccatgccttcgatgaaggcgtcgatgacctgctcgtagcgctcgagcgagaagatcagcgtgacgttgacggagatgcccttggccagggtagcggtgatcgccggcaggccctcgagggtcgcagggatcttgatcatggcattcggacggtcgaccttggcccagagttcctcagcctgcttctcggtctcggcggtctcgtgtgcgaggcgcggatcgacttcgatggagacacggccattgacgtagtcggaggcctcggcgaccggcttgaagatatcgcaggcattgcgcacgtcggtggtggtgagctcgcggatggcggtctcgacatcgaccttgccgagttccttgagctgtgcgtcgtacgggccgacctggctcagagccttctggaagatggacgggttggtggtgacgccaacaacgttatcgttcttgatgagctcttcgagatttcccgactcaatgcgggtgcgggacaggtcatccagccagatggaaacgccggcatcggaaattgcctgagtagatgcagtcattatgtatctcctaatttgtgttgttgaaaaaatccaacgcctaccagtgtaggcaaaggggaggggatgccggatggcatcccctcatagatgaatcagcgagcctcttcgatggaggccttggctgcttcgacgacatgctcggcggtgatgcccagatcgatcatgttctgagcaccgtcgccctgcaggccgaactggtcgatggcgatggccttgccataagagcccaggtacttgtaccaggacatcgcggagccggcttcgatggagacgcgggccttgatgcccttcgggaggatctcctccttgtactcgtcgtcctgctcctcgaaccattccatcgagaccatggagatgacgcgggccttgatgccctcctgcgccagcttcttggcaccttccagggcccactggacctcggagccagaggccatgatgatcacgtccggctggccttcctcgccgtagagcacgtaagcacccttgcgcacgccttccttggccttctcggcggtctcgacgagggtcgggacaccctgacgggtcagcaccatggctgttggcagcgtgttcttcttctcgaagaagtaacggtaggcttcggcggtctcccactcatcggcaggacgaacgacttcgagctgcgggatgtcgcggaaggagctcaggtgctcgatcggctggtgggtcgggccatcctcgccgagggccaccgaatcatggctccaaatgtacaggttcgggatctccatgagagccgacagacggactgcggcacgcatgtaatctgcgaactggaagaaggtgccggagaacggacgggtgtcggaacccaacaggatgccgttggtgatgcagcccatggcgaattcgcgcacaccgaagtgcagctgacggccatacggggagcaatccggccactgggtggtggcatcttccgccggagcgaaggacgcggcgcccttgatgttggtgttgttggaaccacccagatcggcggagccaccccacagctcaggcatgatcggcgcgatggcattgatcacagcgccggaggccttgcgggttgcgaccttggatccggcctcgaagccggcttcgagatcgtcaatggccttgtcgaattcctcaggcagctcaccgttcttgatgcggttgtagagagcagccttgtccgggttggcatcagcccacttctcgaaggcatcatcccattccttgtgtgcctcaaggccgcgctctgcgaccttgcgggcgtgggccagtgcttcttcgtccacctcgaaggtcttcgtcggatcgaggccgagggccttcttgagacccgcgacggcctcgtcgcccagagcggagccatgggacgaaggatcgttggtcttgcccggagtcggccatgcgatgagcgtgtcgaccttgatgaagtgcggacgatcggtgacctgctcggccttctcgatgaccttggacaggccttcgatgtcttccttgtaggaaccgtcgggctggatgaagctgaattcatcggtgtaccagccgtaggccttgtaacgctcgatcacgttctcgtcgagggcgatcttggtctcgccttcgatctggatgtggttggcgtcgaagaagacgaacaggttgccgagctgctcattgccggcaagcgaggaggcttcgccggagacgccttcctcgatgtcgccttcaccgcagatgacccacaccttgtggtcgaacggggacttgccctccggagcatccggatcgagcaggccgcgctcgtaacgctggccatatgcgaaaccgacggcggatgcgacaccctgacccagtgggccggtggtcatttcgataccgggggtcaggccgtactcaggatggcccggagtgcgggtatccgcgccgccacggaagtacttgaggtcatccagcgtcaggccataaccggagaagtacagctgcacatactgggtaagcgatgcatgaccgccagaaagaatgaaacgatcgcgaccggcccagttcgggtcgttcggatcgtgcttgatgaaacgctgataaagcgtgtaggcgattggagccaacgaaatcggggagcccggatgaccgtggcccgccttctgcactgcatcggcggagagggccttcgccatcttgatggcgcgctcatccaattcagaccaggtgttatcggtcataagtgatctactttccttccaatatttcgagcgccggggccgccggcttgtccaacaacgccggcgctcttcacattgcacttacatactaaccgcaataaccgacgagattccgcgcctttggcgtgttatccgctttctctgtgagccggaattagcactcctgtatgcagagtgctaatacaatgtttctcgaaagcgtaataaggggtatatatgagttcgacacgtcgcatgcagattctgcgggccgttgtagaggactatatacggcagcaggaacccatcggatccggtgcgctggcggccaagcaccatttgggagtgagccctgccacaatccgcaacgacatggccgcgctggaggatgaaggctatctcacccagccccatacctcggcgggacgcatcccgaccgaaaaaggataccggtacttcgtcaattcgctgagcacaccgataccgctcaccgcagagcaacgggaatcaatcagcagtgccctgagcggttcggcgagcctgcaggacacattgcagcgcgccgcacgcattctctccaccatcaccggtcaatatgcaatggtgtcggcgccgtcgttgtcccggtcccttatgaggcacgtggaactgctgcccctcgccgcgcatacgctcctgctggtgacgataaccgagacgggccgcgtggtgcagaggttggtctcgacggacacgttgccgaataccgagcagacgcagtgcatatgcgaaacgatcaatacccattgccgcctgctcacgttccgccaatgcgcgcagagcattcgcacgctgccaaccgactccgaggggggattcaccccccagctccgcgatgccatcgcggcggtgttctccgacatggagaatgaggagcgtccaaacgagttgttcacctcaggtgccgcaagcctgacacatcagcatatcgatgctgccagccttgcaccgctcttcgatgctttggaggaacaggtggtgttgatgcgcctgatgtacgatctgacggggcagcctggccaggagggtgtcggcgtggccatcggctcggagacacacacgccaggtctgctgcatgcctccgtggtgagcagcggctatgggcagagctccaccccgagcgcaaatgtcgagcatgaggaatacgacacaggcaccaagccaaccatgccgatcgccgtaatcggatccattggcccgacccacatgaactatgcggtgaccatggccgccgtccatgccgtatcgcggtatctgaccgagttcctgcgcgttggccataatggatggcaggaataacagccgaacctttcgagtagcaatatacagtcataagaatacgtcccagcacaacagaaagagtggccgtggcagattattacagtgtcctaggtgtcgagcgcgatgcgacggaagaggagatcaagcgcgcataccgcaagatgagccgtaaataccatcccgatctcgcgggtccgcagttcgaggagaaattcaaggaggtcaacaccgcgtacgaagtgctttccgacccggagaagcggcgtatgttcgacatgggcgtcgatccgaacgatccccgaggcggagcgggatacggtggcggccagcccttcggcggattcgacatgggcgacgtgttcggccagttcttcgacgccttcggtggaggtaccggcaacggtccgataccacgtagccagcctggccgcgatcagctcgaagagctcaccatagatttgcggaccgccgtgttcggcgcggaacaacacctgaagttttcgacctacggcacctgccagaactgcgaaggcaccggatccgagcacgaggagcctcccatcacatgccccacatgccatgggtccggctacacacagaaggtggtgcgcacactgctcggccagatgatgacctcggtgccctgcgaaacctgccaaggtcacggcaacatcttccaacacccctgcacccaatgtcagggaagcggtcgtgtgcgcaccgagcgtgacgtagtgatccctgtgccgggtggcgtgcagaacgattcccgccttcgcgtgccgggtcagggagaagctggcgaatgcaacgggcagcccggcgatctctacgtggacatcacggtgcgcaaggacgaaaggtttacgcggcagggtgatgacctacactgctggattcgcgttcccatgacatgggccgtgctggggcatgcaatggagatcgattcattcgacggcaagcagcaactcgacatccccgcggggacgcagccggaacagaccgtggagatcaaaaacctgggcatgacaaagctcaacgataaggatcaacgtggcaatctgattgtgcacatcaacgtgcagattcccacgaagctcagcgactccgagcgcagtctcatggagcagttcgcccaacagcagaaggacgaaaaaccggtgcggcagtcctcgcagcccgcaacgccgcagaagaggggcttcttcagcaagatcaaagacgccttaggctgaaatcacttagcatctggcgacgcaactgatttatgtgatctatgcgaggggtcggtgcgacatccaactggatgtcgcaccgacccctcgcatagatcacattcactgccgccgacagctattcaccgcagcagcgaacgacacatctgccgatactcgctcacataaccgccgccgaagaacacgcagtggcccgcaatggggtagagctgccatatcgtgatgcgctcctgccaacccgccttcagcggatgcaccgacatgtagccatcggtgatctccgtcagataactcatgccgaacagatggagcatggcgagatcctcctcccggtgtccgccatgggccgccggatcaatgagcacggcctgcgtctcgccggtgtctgccgtccacatcacattgccgctccacaagtcgccatgcacacgagcgggtctatcttcgccggccctgccgagcagttccggaagcgcatcgatgacctcgttggtgagatccatgtcggcatcacgcaacgacccgcgttcgattcccatctgaaccatcggacgcagacggccttcggccaaatatgttgccggatcacgccactcaccggtgtccattggcacaggatcctgcaggggtccgaaataacaggtgccgtcatatcccttcggagccgatccaaaatacggcgcgcccgcatcatgcatatgcgcaagtgcggcaccgaattcgaaggctgctttcccagtcggcatcgcgggggtcacccgctcgatgtcaaggtaatcgtcaccccagccatacaccttcaccacacgcgggccaccctgcgcctgcgcctcgccaagccactcgagacccttgccctcgcattcgaagaagccccgtggcgcattcctgcgactcttacggtattctgcacccatctcagtcctttcgcctgtatattccggtgttcattgtacgcaattcgatgtcgcgaaacggcacggaatgccgctcgatgacctgtgcgactatcgcctccttcggtggaagaggaagggcacacggtacagtgaaactgcaataaccatgaaatcattcgtaaagaggatttatgaatttcttccaggccatattcctcggactggtgcaggcactcaccgaatacctgccggtatcctccagcgcccatgtccgcatcgtcggcgatctcatgctcggcggagacccaggtgccgcgttcaccgccatcatccagatcggaaccgaattggcagtgctgctgtatttccgccgcgacatctggaacatcctgaagtcctggtgcctatgcctcgccggcaaggaggggaaggacagggcctctcgtttcggagcgcataacaaggacgctcgtctgggctggtacatcatcatcgccaccattccgattctcatcgcgggcgtactgttccagcatgccattgagacgacgctgcgcaatctatggatcacggtggccatgctgttcatattcggcgtgatcctgtggattgtcgacgaccgcgcccgccaggtcaagacactcgacgacatgaacacgaaggatgcgatctggtttggcatcggccagatgctcgcgcttattccgggcgtatcacgctccggtggcaccatcaccttcggacgagcaatggggtacaaacgcgaggcggcagtgcgcgccgcattcctcatggccatccccgccgtgttcggcgcaggcattctcgaagctgtcaaggcgatcaaagacgtcaatgccgacgcgatgttcccaggatggggcgccaccatcgccgccaccgtcgtggcgtttgtggtcggttacatcgtgatcatcggattcctcaaattcgtatccacctattcctacaaggcctttgccatctatcgcatcgccctggccatcatcgtggctatcttgctgttgtgcggcgtgctctcgccgctggagggcattccggtctccggtaatgcctgatatgtcctgccttggatatgagaatacctcccgattcgggaggtattctcatatccaaggcaggaggcctatggcgctagggagaactggctctcaatcctgatcccgtaggaatgcctcggcctcctgcaccagctgctcagccatcggcgtccccgccgacgaaagttccttggcatgctgatgcagatcgtaatcacgttccagctgactcacgaaatgctcgaaatcaacgttgttacgcacggtgacatcgcaccgggaacgccattgtttcgctttgttctctatggtgcccgccggaagatcgagccccaagatctcgccgagctcccgcaacagtgtcagggttgcctgtgggcatggatcagcggacccgagatagcgggggatggaaacccacagggatgtggtgttgaatccctgttcgatggccatcatgtcaagcgcatgcgtgattccgatgggcccattgtattcataatcaggatccagcggcttgccgttgttcgagatatctatgggcaacgggcgcgtgtgtgggcactccgccagcatggatcccagcgtgacgatgcattcgacgtcatactgttcggcgaaacgcaggctaccgcggcagtattcaagccactggtagttcggctccggccccaattgcgcaagaatatgaagcgagtcgctcactgcgatgtcatagaaaacggtctgcggccataggatgcaacgtgaaccctgaatggtgcactgcattggacgggcggattggtaatcgtagtatccgtctttgttgatgtggccaatctccaaagacctataacgggagaccagatgccgaatcacatcggtggcactctggcatgcgtcattccagccatcgaaggccgcgaccatgacgtatttgactctggttcctcgctcattcatggacaccactgtatcccttgaaaagctgcattttgtgaaggtaatcccacagtgaagcaatgtggaggaaccgtgagcaaaacgcgcggtcactgttgtgtatctctctactgcaatcctatacggagagatgatccaacgattacgacacgccgaacttgcaaacttccaggagttcgatatagtagtgactcgtgctcaggcagaggaaacaacgccagaaacacatgcggacatagcttagttggtaaagcgcgaccttgccaaggtcgagaccgcgggttcgagtcccgttgtccgctctaaggtccgatgagtttaacgaaccttacggtgggttagccaagcggttaggcagcggcctgcaaagccgtatagacgagttcgactctcgtacccacctcgacggcatcgaaagatgcccgggaccaaccgggcggttggcgcagaggtagcgcacttccctgacacggaaggggtcacaagttcgaatcttgtatcgcccacgatccgagccatcggatacaataactgaatacgggtgattggcgcagcggctagcgcacttccttcacacggaaggggtcgtaggttcgattcctacatcacccacctgaggcctcgtggactgttgtccacgaggctttttgtttcggcttgtccgttggcatcagggtcgacatgccgggcgtatagaactaagcgtgttgtgcgcctggggcggcagctgagacgcatgaataaatatcggtcggccctggcaaggattgggtctcatggcttaatcaagacaacgacgacggagtccaagaatactagaccgtccccaataccgagaaggggaatgaaacgcccagagacagaatacgacttataaaccactattcaggcactgctcattgtatcgggcacgggtcgaactgtatattaagtggctgggtaggggtgcttctcattcccggttgtatcgctagccgaggaatgatgcaacaatatccatcacgcatgaggaagcgtatgccattgcgatggtgcttgccctcgtatgcagaccatggcagggggaatgtgcatgacagcgcttttcatcagtgcaatggccttttggactgcggtgattaccgcagtcatagtgctgtgcaggcatctgcataatgtacggcggcaaccagatgggcaggcgaaagagggcgcacctgatatgagggacgaagggaagagtcatgaatgaacggcaagcaaacagagctttcgcgttggctcgcaagatatggcaggccacctcgaggccggtttaccgactcggtcggcacttcgtcagttttcattggtgcacggccgtcatgacgttcatctatctgattgccgcaggcgccctggtatggggtgagcgcaggtgggtcgataccgtgttcctgatcctcatgctgatcatatacgcggtcgtctccgaaacgtatgggtacctcacaagcaggaacaggctcgttccgcgtccggtgaccctcagagggctgctctccagagcggttttcattctgctctgctatgcgaccccattcatactgatcatggcgtatacctgattgcaccatgaatacgaagcacacaatacgcccatcgaaaggaaataatggtctggatcatcgcggcaatcgtcatcctcgcgatatccgtgtatttcgccaatgagtaccgcctagaccgcaaggcgcaccgcttgcgcgacggatcggaggaagacaggcgtctcgcctccgaattgcaggacattgcccgcaacatggatgaagggaaatacctctatcgatgaccgtgccacaccagcgggcatcggggaacagggcgaaagatgtgatcagcaagcggtcaatgcatgtttcataatcaggtcggtctgcgcatccgatccaagcacgaaagtatgtgcaccggtttcgacgaatcccattctacgatagaacgccttggccggttcgttatgctcccatacgccgagccacagcgtttgcttgccatgtgccgacgcgaactgctctgccgtacgcatgaacctggttcccaaaccgtgacgtttgaaatccgcaagcacgtagagtctctggacttcggcatggtcgtccggcatacgctccgtttgcgccgtgccgagattgaccttcatataccctgccggcacaccatccaccgttgcgacgaaaaacgtctgcagcgggtctgccagctccttgcccaacacctcgggggagagcccatgggcgatatagtcgcgcatatcctcttcggtattggtaccggcgaacgtctgcctgaaggtggcgatgctcagatcgcgtattgtctgcagctgcgtgttttcggcaatggaaatctcactcatgttcagttcctttccaccggtgtcgtgcgctatctgaacatacacgacacgccgaagttgcgcaatcggaaaattatagtaaattaataactcgtgcttcaagcacatgcggacatagcttagttggtaaagcgcgaccttgccaaggtcgagaccgcgggttcgagtcccgttgtccgctctcttctattttcaagcacattctcccacatgccaagagaatgctcaacggaggtcggcaagcacttgcgcatctggacacagtgagtaacccagcaaaccagacgcgttacgcgtgctgccgtgtccactgtgcacagtgattcccattcgcattcaggtcttactcgctgtttcacacatatgcagtacgccatatcggcaaggagctgacatggtaggcaatctggtgcttcacgacatctcatatcaatacacagattccagcgaaccgctgttcgatcatttcaacgcgtcattgtcacacggttggaccgcgttgctcgcagacaacggtctcggcaagaccacgctcgcgcaactgatctgcggacggcgcacacctacgcggggcgaagtacagccgagtccgcggacgctcatctgcgcgtactgcaaacaggaatgcgtttcggaacctgagggactcgcagagttccgcgatgactggttcgccgaatccattgccttgcgcgacgcactcggcatcggcgacgattggggttaccggtatgaccccctcagtggcggcgagcgcaaacgtctgcagatcgcctgtgcgctatactcccgtcccgatgtactggtactcgacgagcccacgaatcatgtcgatgagcatacacgcgggatcgtggtgagtcacgagcgttggttcctcgacgaagtctgcggaaaacagtgaatgggtctggataccgaccgggaaggcaatccgcctcgagcagatgacggcacgtccgaatcgcgctgccatctgctcacattggttcgccgaagcctgtcaggtgtgagacaggggagccactttgtctgaactgaaccctaagttttatgtcgtaacactacatagtccaggtctgcaccttgtaccgcggacccagatagcaaaggacacctcatggcagaagcacacatctccatcacagtcaacggcgaggcgaaggaggtggaagcaagccagaccggcgtcgaactgttcgcagacgacaagaacatcatcgcagtgcgtctcaatggcgagttgcgagacctctacacgcctctgcacgatggcgacaacgtcgaatccgtgaccctcgactcgccggatggcacaggcatcatgcgccattcggccacccatgtcatggcacaggccgtgcaggaggtacgcccggatgccaagctcggcattggcccggtgatcgagaacggtttctactacgacttcgacgtgaaggatccattcacgccggatgacctgaagaccatcgaaaagcacatgcaacgcatcatcaagtcggcgcagcgcttccagcgccgagtggtgagcgaagaggaggccctgcgcgaagaggctgatgagccgtacaagatcgagctcatcaaagacaaggaagatgcgctcgagaccgaggcggccgtagacatcagccataaggagctgagtatgtacgacaatctcgaccgtgagggcaatgtggtgtggtcggatctctgccgtggaccgcacctgccgaacacccgctatatcaaggcattcaagctggagcgcgccgccgccgcgtattggaagggttcggaggcgaaccccatgctccagcgcatctacggcgtggcgttccccaccaaggacgagctcaaggcctaccagacccgcatggaggaggccgccaaacgcgaccaccgcaaactcggtcaggaaatggacctgttctcgttccctgacgagatcggcccgggtcttgccgtgttccatccaaagggcgccgcgattatcaacgcgatggaggactactcccgcgagatgcaccgcaagaatcactacagcttcgtgcagactccgcacatcaccaagggcggcctgtatgagacgtccggacacctgcagtggtacaaggacggcatgtatccgccgatgcatctggatgaggaaaaggacgagaacggcaacatcgtcaagcagggcttcgactattacctcaagccgatgaactgcccgatgcacaacctcatcttcaagtcacgccagcgttcctaccgagaactgccgttgcgcctcttcgagttcggcaccgtctaccgctacgagaagtccggcgtggttcacggactgacccgcgtgcgcggtctgactcaggatgattcccacatctactgcacccgtgagcagatgaaggacgagctcaagaacctgctcaacttcgtgctcaaagtgctcaaggactatggtctcaacgatttctacttggagctttccacgaaggacgagcacaagttcgtcggctccgacgagatctgggaggaggcgaccaacaccctcgccgaggtggccgaggaatccggtctcgaactcgtggcggatccgggtggcgccgcattctatggtccgaagatctcggtgcaggcccgcgacgcaatcggacgcacttggcaggtctccacgattcagctcgacttcaatctgccggagcgtttccagttggagtacatcgctccggatggatcgcaccagcgccccgtaatgatccatcgtgcgttgttcggttccatcgagcgtttcttcgcgattctgctcgagcactatgccggcgccttcccggcgtggctggctcccgtgcaggctctcggtgtgccggtggcggacgaattcgccccgcatctcgacaagttcatgaattcgctcgaagaggaccttgtgcgcgtcgagaccgacaattccgatgatcgtttcggcaagaagatccgcaacgcctccaaatcgaaagtgccgtacatcatcatcgccggcgaggaggatatgaacaacaacgccgtgagcttccgcttccgtgacggcagccaactcaacggcgtgccggtcgaccaagccaaggcgtggattctggagacgatcaccaagcgtgtgcaggtcaacagcgtcgacgacttcaaggcagccaccgggcagcctgtggagaatgtcgagttcggcgtcgcagacaccgacgccgagtaaaacaggacgcactgcgaatatcacggcattcagcaccggtggggtcaggcgcattccagcgccggccccaccggtgtttttccaaagccattcgcaagcaatatctgcgctgttgtctattctcatagtgtttctactcattgaccccaggacacaacatgctggaaaagcttcgaccatggttcaagcggctcatcgcgccgatcgcacgcgcattgacgcgaatgggcatcaccgcgaacgcggtgactgtcatcggggcggtcggcaccaccattgtcggcatcgcatccggaatcaccggatggatgttctggggagctttggtactcaccattctggtggtgttcgattcgcttgacggttctgtggccgcaatcaccacaggaggcacgaaattcggggcattcctcgactccacactcgaccgtatagccgactgggccgtgctgctcggctgcatcatctatttctttgtgcgcaattccaccttcactgcagcacacgccgggcaacgctacgactggatttgcgtgagcggcatggcgttggcaatctattcggtcatgacctcgttcgtcacctcatatgcacgtgcacgagcacagtcagtcggctacgaggcgaaaaacggcgtagcgacacggtccgaccgcctgacgatcatcctggtcggcatggccatatgcggcctggccaacaatccgctctggctcatgatcgacatggccgtgctcgcattgctcggcacgatcaccgtgttccagcgcatccgcgaggtctatgtgagcatgcgagccaacggcgacgccggcgtctccaagcagtgacggcacgcagccgtcgcctgtacgaccgggctcataggcagagtgtgaaaggcgaattgtgatgttcgacagattgatggcatggctcgcacgccacccgaacgcgctgcccgagcgtatggttcgaggggggttccttgctgccgcggatgtgacgtgggcattgcacatcggttcggtaaggcagctggagcgcaatctagcccatgtgctctcctggcgtgacggaacggatcccgatagaaggacgttgcgcaaactctctcgcaagggcatgcgttcgtatttcacctatttctccgaggcaatgaccgttggcgcgcgatccaaggagcaattgcttgcgcggatccatggttcaggggacggattcgaggcgatcaaacatcaggcgggttcggaggggacaggctccgctccgatcgccatgggacatcagggcaattgggactacgacgggttctgggcgcaattcgatgtggcaccggtgaccacggtggcggagaaactggccaacagggagatgctcgacgcgttcgtgtccatacgcgaacatctgggcatgaccatcttcctgacaggcacgccgaagctcaccgaacgtcttgaggaggcactgcggactccgcatacgctcgttccgttgctcgcggaccgggatctgagccgccatggcgaattcgtgaacgcattcggatcgttcatccgagtggccaggggaccggccgcaatagcattcgacaccggaacgccactgttcgtcgtcaacacctaccgcgaaaaactcagcggggaacgacgccgcttggcgcgcacaccatacggatacgtatgtgaagtgagtgggccgatcgatgtggagcgataccgttccatgcctcgtgaggaggcaatccgctgcatctgccaggattgggtggacatctgggcaagaggcatcgccgcacaccctgaggattggcacatgctccaaccgatattcctggaggatctggatatggagcgtctcaaagacgtccccgaggagttgcgagcacaagcaacgatgtcacggtgaaagtccagcgagtcgagcaagatgccaatatgccatcgtttgacaggaatacgccgtctttgcatacgaagagcggaacggcaggacaacagaacgcactacgtgtaggcatcatctgcccatactcgttcgagacgccgggcggtgtgcagaaccatattcgcgatttcgcccgccaactgcgtcggcgcgggcacgaggtccaagtgttcgcaccaggcaggagaaccgcggacatgccccaatatgtccatacgaacaactcctcgttcgccatcccgtacaacggatcgtgggcgcatctgagctatttcctcaacgccggccataccaccagaaaatgggtgcgtgacggcggttttgacattctgcatctgcatgaacccgaaaccccttcactgagccacaagcctctcgtcatgcatgatgcgccgcccatggtggccacattccatgcctcgatcgaaccatatccacgcgcgctcagattgttcacccgctacctgcgcaaatacctttcgccgctgagggaagcgatcttcgtctccgagtccgcacaaaagaccgccgaacactatctgccacagcaagtgggggtccagaccatccccaatggcatcgaatgcgatttctaccgacgcgcggagccgaacccacaatggcagggcagtccagaggcgccgaccatcggattcctgggccgtatgggtgaggagcgcaaaggattcacggtgttcgctcaggccgcgaagattgtgcatgaggcattcccgagcgcacggttccttgtcgcaggcgacggacaggaggacggcggaaaaacactcgacgccattggcgccgacaaggggctgcgggaacgcttcgaattcctgggacgtgtaagcgatgcggacaaagccaggttctatcgctcgttgagcatgtacgtggccccgcaaaccggcggcgagagcttcggcatcgtgttggctgaggcgatggccgcgggctgccccgtcatcgcctccgacctcgatgcgttcagggccgtcaccgaggaggggagcagtgcagcattgttcgtcaatcgcgatgcgaatgattgcgcacgccgcatgaccgagctcatcgaggatccggcgcgccgccaatccctgtcacaggccggttccatacgctccaggagcttcgactggaataccgtggtcgatgaggtactcgaggtgtatgcgaaggcgttgtcatagaaacgctgtaaaatcaacacgttctaagaatccgcaatctttgtaggagcaatatgtcaggccattccaaatgggcgaccaccaagcacaagaaggccgccatcgacgccaagcgcggcaagctgttcgccaagctcatcaagaacatcgagatcgctgcccgtcagggcggtggcgaccccgatggcaacccggcgctctatgacgcgatctacaaggccaagaaggcctccatgcccgctgacaacatcaagcgtgcagtcgcccgtggatcgggtgccgaagccggcggcgccaactatgaggagatcatctacgaaggctatgcaccggcaggcgtcggcctgatcatcgaatgcctgaccgacaatcgcaatcgcgctgcggccgacgtccgctccaccctcggcaagggaggtggctcgctggccaccaatggtgccgtgagcttcaacttcgagcgcaagggtgagatcgtcgtgccgtccgaggggcttgatttcgacgatctgttcgagaaggccgcagaagcaggcgctgaggatgtgatcgacgatggcgacacctacacggtcgtcaccgctccttcggatctgatcacagtgcgtcaggccctgcaggatgccggcgtcgattacgactccgcggatctggtcatgcgcccgaagaacgagatcgagcttggcctcgacgacgcgcgcaaggtgtcgaagctcatcgacaacctcgacgatctcgatgacgtgcagaacatctacagcaactggaccgcgtctgacgacgtgctcgcccagctggacgaggagtagtcatccgtgatcgttctcggcgttgaccccgggctcacacgctgcggggtcggcgtgatcgaagccggcgcataccgccggctttcgtttattcacgtcgatgtggtgcgaagtgatccgcacgaatcgcaggatctgagattgctcaagatctacgacggcctgtgtgcgaagatggacgaattcattcccgacaccgtttcaatcgagcgtgtgttcgcccaagagaaccgaaacaccgtgctcggtacggcgcaagcggccggcatggccatgctggccgccgcccagcgcggtattccggtggcgcttcacacgccgaccgaatcgaaaatggcgatcaccggcaacggcaaggcggagaagatccagatggagcgcatggtggctcggattctcaatctcaacgcattgcccacacccgcggatgccgcagacgccttggccatcgccatatgccatgcactgcgcccatccggtgcacttgaaggcggcgaacgcgagcaacatctcaccccggcgcaacgccaatgggcacaggccacgcagcatgccacccgtagaaggggagtccgcagaggcatgtaaactaccgaacatatgttcgaattcggcaggaggactaatgatcggaatgctcaagggccgggtcgagtcggtggacacttccaatgcggtggtggacgtccatggggttggattcgaattgcgtatgccttccaacgatctcaccgccatgcatatgggccaggacgtcaaaatatacacatccatgagcgtctcgcaggacgccatcacgctgttcggattcctcgacgccagatcgaaacgcatgttcctccagctgcagaaggtgagtggcgtcggaccgaaggtggcgctttcgcttctgagcacgctggcccccgacgaccttgcacaggcaatccacgacggtgacgacaaggccttgtcacgcgcccccggtctgggccggaaaggtgcccagaaaatcatcctggagctcaagggctcgattgacgtcgacaaaatcgaaacaggggagccaacttccacgcaacgcatcccaaccgacaagggggtcgaacaggtggttgagggtctcatgtcgctgggctggaagcaggcggatgcacagcaggctgtggattcggtcatttcctccagtggcatcgcgttgccactggaggaaggcaatgtgccgactgtgctcagactggcattgacatcactggacagagggaggtaattcgtggcaatcgcgaacatggagccaatggagtattccggagccgacaacctcgatgcccgggatgaatcgttgcgcatggtgtcggccgtgccggtcggcaatgaaccggtgagcgacgaggagctgcgtcctcatgtgttggagggcttcatagggcaacccagactgaaggcccagctgcagcttttccttgatgctgcccgcaaacgtgatgtggctcctgatcacatcctcatggcgggtcctcccggcttgggcaagaccacattggccatgattgtggccaatgagcttggggtgcccatccgggtcacgtcgggaccggcgattcaacatgctggagatctggcttcgattctcagttcgctggatgtgggcgaagtgttgttcatcgatgagattcaccgacttccacgcgccgcggaggaactgctgtatatagccatggaggatttccgcgtggatgtgatggtgggcaaggggcctggtgcctcttctattccactgacgctgcctcggttcaccgtcatcggagccaccactcgcgaaggcatgctcccctcaccgctgcgcgcccgattcggcttcaccgcgcatctggatttctaccctcacgaggaactggaaaaactcatcgaacgctctgcctccgtgcttggcctcccattggaggatcaggctgcgcgacagttgtcgctgcgctcacgcggcacaccacgtattgcgaaccgtttgcttcggcgagtgcgcgactgggctatcgtgcacgatctcgacagcgtgggggcggacgatgtcaaagacgcactggctctctaccaaatcgattccgaaggactggaccgcctggacatcgccgtgctcaatgcaattgtccggcagttcaacggtggcccggtgggtctcaacaacctatccgccatggtgggggaggaggccgagacagtggagactgtatgcgaaccgtatctggtacgtgaaggcttcctgattcgcaccccgaaaggccgtctcgccaccgccaaggcatgggagcatttgggtctcaaacccgacgacggtacccccgatgatgtcagcaagctattctaagcttaggatttcgtgggctattgccccttctcatgtttttaaggagtccactcatggaatatatgatgctcatcgttctcatcgtcctcatgggcgttatgatgttctactcttcccggaaggccaagaagcagcagcaggagcgtcaggcgttccgcacgagcctcgctccgggcactgaggtcatcaccatcggaggcctgatcggcaaggtcgtggaagtggacgagcagtacgaagaaatcgtgctcgactccgaaggatcgctgctgcgcttcagcctgcagtcggtcagccgggcctatgttcgtccggcctatgtgagcgacgacgacgtcgacgagaacggtaatccactgccgaaggacgaaccggcgcagattacctcgaacgaaccggaatccgacggttccgagaccgtcgtggaggaaacctccgtggttgagaccccggaggacgcggattcctcaccgttcgaaacacagtccaagtaaactgccaataccaccgccaacccgccgatcaacgaaggtgaacatgtcacagaccgacattcatgtggccaatgctgccagcatgtcgcaagacgatgcccgctacctcatctcactcattcgcaccgttccggatttcccccgcgaaggcatcctgttccgcgatttcatgccagtattcgccgactcccgagggcttcgtattctcctcgacgcgctcatcgccgctttaccggtgcacacagacgaattcgatgcggtcgcaggccttgaagcacgtgggttcctgttcggacctgcccttgccgcacaactcggcaagggattcattgccattcgcaaggccgggaagctgcctccaccggtgcatgcatgcagctatgcactcgaatacggcaaagccaccttggagatcgaagacaccagtgtccgaaacaatgaacgtatactcattgtcgatgacctgatcgccaccggcggttcggctgcggcggcgaaggacctcatcgaatcggctggaggcaaggtcgcaggctacgaattcgtcatggaattggagggccttgacggacggacggcgctcggcgactatccatacggctcgttgttgaagatgcccgcttaggaaacagtggagtagaggaatatggatctttacgaatatcaggcacgtcagctgctcgaagagcaggacatcgatgtgccgaaggcggtgttcgcacagaattcacatgaggtggccgaagccgccgacatcatcggatatccggtcgtgatcaaggcacaggtgaagatcggacatcgcgggcaggcaggcggtgtgcgcattgcacatgaccgtgacgaggcgatactcatctccgaggatatccttccgatgaccatccatggtcataaggtgagtggcatcctggtgaccgaagccaagaacatcctccacgaatactatgtgtccatctcggttgatcgctcctcgcgcgacttcgacgtcctggccacggccaacggcggcactgaagtcgaagaagtcgcacgcaagcatccggaatctgtgaaacggctgcatataagcgctcttgaggacttcgacctcgaagcagcaacaaaaatggccgagagcatcggcttctaccacgcggattcagctcaggcggcgcagatcctgctcaacatgtggcgctgcttcaagcagaacgatgccaccctcgtggagatcaacccattggccaaagtcggcgacccggacgacgaatcttcgaagtcgttgtgcgcattggatgcgaaaatctcactcgacgacaacgcagccttccgtcacgatggatggaagcgctttgccgacccgatcgtcccggatccgtttgaacagcgtgcccgtgaacacaatctgcattacgtgcatctcaccggcgaggtcggtgtcatcggcaacggggcgggcttggtgatgagctccctcgacgccgtcgcattcgcgggcgaggaacagggcaccggtgtgaaggccgcgaacttcctcgacatcggcgggggagcctcctcgcaggtcatgtgcgaaagccttgagatcattctctccgacccccaggtggaatccgtgttcatcaatgtgtatggaggcatcacctcctgtgaacaggtagctctcggcattctcgaggcggcggatcagctcggcgcatccaagccgatggtcgttcggttcgaggggaacaaggccgatgaggggcttcggattctcgccgaggccgataacccgaacatccatgtatgcgagaccatggggcaggcggccgccgaggcggctcgtctcgccgcccatggcaaggaggagcgttaagtgaacgtgttcatcgaagatgacgcacccgtcatcgtacagggcatcaccggtcatcagggcatgacgcacaccgcacgcatgctcaaggccaacacgaatatcgtcggtggcgtgaacccacgcaaggccggcaccaccctcgaattcgaagatggaaacggcgtccccgtcagggtaccggtgttcgccacttgccaggaggcaaaagacatcaccggtgccaaggcatcggttgtgttcgttccccctcgtttcgccaaggacgccgttgtcgaagccgtcgaagcaggcttcgaggtggttgtcgtgatcaccgagggcatccccgtggcggactccgcctatttcgtggaactcgctctcagcaaaggcgtgcgcatcgtcgggccgaactgtccgggcctcctcaccttgccggaatccaccgatacacatggcgtcaaccttggcatcattcccgacggcatcgtctcgcgtggcccgttgggattggtatccaaatccggcacactcacttatcagctcatgggcgaactctccgacatcggtttcacggcctgtctcggcgctggcggtgatcccatcgtgggaaccacgctgctcgaggcgctcgaagcctttgaagccgatccgaacaccaaggcggtcatgatgatcggcgagatcggaggcaatgccgaacaggatgccgcacaatgggccgccaagaacatgaccaaaccggttgttgcctacatcgccggattcaccgcccccgaaggcaagcagatggggcatgcgggggccattgtgtccggaggcaaggggactgctcaggataagcaggcggcacttgaggcggccggcatccgagtgggcagaaccccctccgaggctgcgcagatcatgcgtgaggtgctttccgcgcagatatgatgaagcagataacgccctggttgaaaggtgtgctcgcaccggttctggtcatggtgatcttcgccattccggtcggtgtgttcatggcgctggccctgctggtcttcgccatggaagagggcggcgagacgatgtcgtcgttcgctgtcccactcaccagagtcattgtgttactcagtcagggtatcggcatgcatgccggggcgattaccctgaccatcacgcctttgctcctgacactagcgatgatcctgctaatccgtgccgtctactcccactggagcacggatctgccagcctatcttgcgggcgtggcaacttggattgtgctctgcctatggtgcagcggtgaaacacgcatccaactcaccgattccatttggctcatcgcgctcaaatgtgcggtggtgttttccctgggcttcgcgtggagagcgttgcccggctccgcactgatggacagggggcgcctctactgccgcgagcacatctcccaaccagtgcgttccagcattcatgtcggtgtgcgtctggccttgcgattgctggtgatattcctttccatcggtttgattaccgtgttcgtttggatttgtctggatcattccagcatggtcaccatgttcaagacaatgcacatgaacaccggatcgcgcatcctcatgtgcatcatggccttggcatggttgcccaatatggcgttatgggcattgtcatgggtattcggcggcggattccacattgggcaggccgcctcatattcgttgtggtcggcgcagattcacgagttgccttcgcttcccatattcgctttgttcccccatcctgtcgacaatgcgggcattcgcacctgtctgatgctgattccggttatgctgggattcgtgttcggtttgctcatgttgctgctccaccggggtttccatgtgcggggcattgatccgaatgagcccgtggacgtacgcgatttgctgttgcgcttcgcatacccggctggcgcattctgcatcacggccacactggtctccctgatgagcagcttggcattctggctggccaatgggtcgctgggagtcggcaggctccgtgatgtcggggttgatgtgatgcgctccacaaatgtggtggcaaggccatgtgcgattggtctgggaatatcctggatcagcgcgatcgtgatcgttgccatccactcgctcatgctcatgatgttgaaacgacgggccgcaaaccgcacttcgttgccgttggaatccgcggattcccctgatgacgaacgcaaagaacacaaaaccccccataccccacgcgtggtcaattccacgtttacgcagaaggagacgaaaggtgacgactaaccgaccgattcgcagggcgttggtctcggtattccacaaggagggcatcgaggtgctggcccaggcattcattgatgccggaaccgaggtggtgtccactggttcaaccgcgaataagctggcagagctcggtgtgaatgtgatcgaagtgtcgcaggtgaccggtttcccggaatgcctcgacggacgtgtcaagacgcttgatccgcatatccatgccgggattctggctgatatgacgaatgaagaccatgcccggcagctcgaggaattcggtatcaagccattcgacctggtggtggtcaacctgtatccgttcgccgataccgtgcggtcgggagctggggagtccgacgtcatcgaaaagattgacattggcggaccatccatggttcgcggggctgcgaaaaacagcgccacggtcgctattgtcaccgatccgacggactatgccttggtggccacgcgcatcgagaacggcgagggattctccttggaggaacgccgttggctggcggcgaaggcctttgcccacacagctgcctacgatgccacgatcaacgagtggaccagtgcccattggccgaaacctgcgagcatcgacgagaccattgacaccatcgctgacgcgggtaccgaggatccgaccgagcaggtgaagcttggcaagttcccagcccaatacacccgctcctggaaccgcgcgcatattctgcgatacggtgagaacccccatcaggatgccgccctgtatgtagatccgctcaatgtccgcgggttcgccgacgccgagcagcttggcggcaaacccatgagctataacaactatgtggacgccgatgccgcgtggcgcgcggtatgggatttcgccccccagatcgccgtcgccgtggtcaagcacaacaacccgtgcggactggccgtgggaaccaccgtcgccgaagcacaccgcaaggcacatgcctgcgatccaatgagcgcctatggcggtgtgattgcctccaacgccacggtgacgctggagatggccgaatacatccgttcgattttcaccgaggtcattgtggcccccgattatgagcccgaggccctcgcacttctccaagccaagaagaagaacctgcgcatcctcaaggttgccgaaccccccaaggccaaataccagttcaagcagatcgacggagggttgcttgtacagtccaccgatctgattgatgccccgggagaccatccggatgcttggaagcttgttgccggtgaggccgcggacgagcgtacgctcaagaatctcgaattcgcatggcgcgccattcgttgcgtcaaatccaatgcgatcctgattgccgacgatatggcgacggtaggcatcggcatgggacaggtgaaccgcgtggattcggcgcatctggccgtggaacgcgccaatacgctcgatgatgggcgcaaccgcacgaagggcgcggtcgccgcctccgacgccttcttcccgttcgccgatggcgccgaaattctcattgacgccggcgtgcgcgccatcgtgcagccaggcggatcgattcgtgacgaggaggtgttcgaagcggcacgcaaggccaatgtgaccatgtacgtcaccggcacacgccacttcctccactgagtcatttgcccttgaaaccggctgttcgaaccggtgtatggcagatgacgcatggaaggcccgacagccgcacggttgtcgggccttccatcatgttacgggcatacatgcaggggatagggtaaagtatgcagcaatcactgggaggagcaccatgagcagccatcatccatttgtctctgagagccatgagggcaaacccgcattcgaatggggagtggcgctctgtgtggtggtctccaccgtattggctgcatgtggcaaagcaatggccgccacagccctactgtctgtgacggccattggaaccagtgtgctacggactgtgttgcgggaacgcagcccgtggaagattcgctcagtgacgttcgactccatctgcggaatcagtctgggagtcatcctgttcggtctcttcctcagcgtcctcttcctcaatcactgaatagtcgttgtcggtctgttctccggtcagtggaacattgtagttctctgcttcggcgatctgaaccgcctcggcctcatcttccgccggaacctcaccggcctgtgccatggcggcctcggctacatccgagtcgacgctggtcttcggagtgcccagcagctgggagacgatgatcaccaacgccacaatggcggcggcgagaatggcggtgacccagaacacccagagttgggcaagcggttcctgcgtgagaccctgcccctgggcgaacacggcgatgcctgtggcacgggcaggattgatggaggcacccgtcacagggaagctcatggctgacgcggcagcataggcaacacccataaccagcgcatagtccgacctcaccttgccatgcttgcgcatcgaaaccatggcggccgccacgacgatgatggaggcaagcagctcgacgatgatggcgacggtgatgctgaacgtgagtcccagcgaattgagcgatgtgtacagcgacgaacccttgtcgtatccgttcactgccatggcataccactggttggcggcgacgctttcggaggtgggcagcacaagcctgagcaatccgccggcgacaatggcgccgagaatctgcgcgacgatgtagcagatgccgtcccacaccttcgtcttcgaggtgagcatggcggccacggtgacggccgggttgaactgtgcgccggagattcgtgcgaagattgcggtcatggccgcgtagatcacgccgacgcagacggtgacgaaggcaaggttcacgttatagaacgccgaaccgaaagtgcacatgagatagatggcgaagcagatgagcagggacccagcgaactcggagagtgcacgcgcccacagatcatgccctttctttggctggactgaagcggttgttgtcgtatcggtcatattgttccttcattcaaatggcagacgcaaagcgttttgcgaccggaacccatcatactcaacaagctgtgcaagtgctcgtcaaggcttgacggagtaccgtccgcacagtatattgagaaagttatatgttattcggccacgttgggagaacgatgccacatatctacagtcaagccagaaaacaatatgagaacgacggcgacggtattcgcctgcagaagcttctggcgcaggcgggattcgggtcccgccgcaaatgcgaggaaatgatcaccgacggccgtgtcgaggtcgatggcgaactcgtcaccgaactgggcacccgagtcgacccgaaacgccagcaagtacgtgtcgatggctcacgcatacgactgaatccgcggcacatcaccttggccttgaacaagccacgcaaggtgctgagcacgatggacgatccgaaggggcgctacacgctgcgcgacatcgtcggcgacaaatatgagcgcatcttccacatggggcgtttggactacgattccgagggccttattctcatgacgaacgacggcgaactaagccagcacgtcatgcatccgaaatacgaggtggagaagacctacatcgccacgttggaaggtcatatgagcggcacagtatgccgtcgtctcgtacgcaccggcgtacagctcgacgacggctggatcaagctcgaccactgctcgatcatcgattcgaaccgtgaccagaccatcgtgaaggtagtgctccattccgggcgcaaccgcatcgtccgccgcatcttcggtgccattggcttcccggtcaaacggctggtgcgtacgcagatcggcccaatcaagctcggtgacatcaaatccgggtcctaccgtgtgctgtcgcaggatgaggttcgcgcactctcgaaggaggtcggtctatgattcgtgtggcaatcgatggccctgccggcgtgggcaagtcgtcctcgtcgaaggcccttgcagactattttggattcgcttacctcgacacgggcgccatgtatcgtgcatgcacatggtggtgcctggagcgcggggtcgacctggatgcggaccatgtggatgagcagcaggtgacggagattgtggcggccttcttcaccgacggccatttcgacatcagcgtcgacccccagcatcccggcgtcttcgccgacgacgtcgacatcagcgagcagattcgctcgcaggaggtctcatcccacgtatccagactcgcggcgattatgccggtgcgcaacgtgctcatcgcggcgcaacgtgcctacatcgcggctcaaagcgccgatgattcgttctcgcacggccgtggtgtcgtagccgaggggcgtgacatcaccgacgtcgtggaacccggtgcggaggtgcgcatcctgctcacggcccgagaggaggtgcgtcaggcacgccgcaacaggcaggagcagaccggtggagtgggcagcgatgatgtagcgaaacgcgacgccgccgactcgaaggtcacccacttcacggaggcttcggatggtgtgacgacgatcgacaactccgacatcgatttcggggagacgctcgatctgatgattggtctggtcgacgacgcgatcgaggagcaggcataccggcaatatgccgccaatctcgacgattacgaacttgatgagggcgatgagggtctgctcgacggctccgcattcagtgcagacggagagtcggaccgccgcaaggcggtgggcgtcatcgcagtggtgggtcgtccgaacgtgggcaagtcgacattggtgaaccgcattctcggacgtcgcgccgcggttgtggaggacactccgggtgtcacccgcgatcgggtgagctatgacgccgaatgggcgggcactgacttcaaactggtggacaccggcggctgggaagccgacgtcgaaggcatcgactccgccatcgcgtcccaggctcagattgccgttgagctcgcggactccgtgatcttcgtggtagatgcgctcaccgggctcacacagaccgacgagcgcatcgtgaagctgctgcgtcaggctggcaaacccgtcaccgtcgcggtgaacaagatcgacgaccagatcagcgagtatatggccgctgaattctggaagctcggccttggtgagccatacccgatctctgccatgcatggaaggggagtgggggacctgctcgatgaggccgttgcgcaaatgaaaagcgccgaaaagacctccggtttcctcacgccatcccatctgcgccgtgtggcgttggtgggcagaccgaatgtgggtaagtcgtcgctgctcaaccagctctcgcattcggaacgctcggtggtgaacgaacttgctggcaccacgcgtgatcccgtggatgagatcgtgaccatcgacggcgaggattacctgttcatcgacacggcgggcatcaaacgtcgccagcacaagctgtcgggcgcggagtactactcctcgctgcgcacccaagcggccatcgaacgctccgagctcgccttggtgctgttcgacgcctccattccgatctccgatcaggatctcaaggtcatgagcacggcggtggatgcaggccgtgcggtggtgctcgtattcaacaaatgggatctcatggatgaattcgaccgccagcgcatggagcggttgtggaagaccgaattcgaccgtgtcacttgggcgcaacgtgtcaatctctcggcgaagaccggttggcacacgaaccgtttggccaaggcgatgacgcaggctctcgagtcttgggacaagcgtattccgacgggcaagctcaacgcattcctcggcaagatccaagcctcgcacccgcatccggtgcgtggtggcaaacagcctcgcattctgttcgccacccaggcgtcaagtcggccgccgcgcttcgtgatcttcgctaccggcttcctggagcacgggtaccgacgctttctggagcgttcgctacgtgaggaattcggatttgagggatcaccgattcagatctcggtgaatattcgcgagaagaagcgccgtaagtagcgattccaatggccgacgcgcgcagcgtcggccattattcgccccctctgctatattgtgtattcgttgcctttgagcaatacggaccatagcgcagtttggtagcgcacttgactgggggtcaaggggtcgcgggttcaaatcccgctggtccgacttcatgggatttctgcccacctcattttccgtcgtcgatcaatctgccgtattacaaggaatcaattcgagatgatcggacgagactttcaaaaaattaacatactaattcttttctcttcgttgtttacatattttcaactgaaactaggaaatgaattcgaattgtcatgcaaaagatgcgaatccttggaaaaaaggctacacttggcacagttggcataacgatacagggatcctcttcgtatgagaaaggtttgacatgaccgacgcattcgagcgaaccgccgagaagatgaaggcccacggcctgagcgagacggccatagcccaattcgagcatctctatgatgtgtggcagcacgaggacggcaccacttggattcgcgaggaggacatcgagccggtccaggacattcccaatttcgcgcagatctatgagacgatcaaccacgacaaggcggtcgacgcattcgccaagacggcgttcctcaagctcaacggcggtctgggaacctcgatggggctcgactgcgcaaaatcattgttgccggttcgcaggcacaaagccaagcaaatgcgcttcatcgacatcattctcggacaggtggaaaccgcacgcaaccgactgggcgtggagctcccgctgacgttcatgaactcgttccgcacatcggccgacaccatgaaggtgctcaaccgagacaagcggttccatcaggatgatattccgatggagatcatccagcacgtggagcccaagatcgatctttcgacgggggagccggtgtcattcccctccaatcccgatctcgaatggtgcccacccgggcacggcgacctgtattcgaccctctgggaatcgggtctgctcgacattctcgaaagccacggattcaagtacctgttcatctcgaactcagacaatctgggggcacgtccgtcacgcactctggcccagcacttcgaaaacaccgacgctccgttcatgatcgaagtgtcgaaacgcaccgaagcggatcgcaagggtggtcacatcgttcgcgacaaggtcaccggtagactcatgttgcgcgagatgacgcaggtggcccctgaagacgcggcggaagccaagaacatcgacaagcatccgtatttcaatacgaacaacatctgggtgcgcatcgactccctacgcgagaagctggcacagagcaacggcgtgctcccgttgcctgtcattcgcaattacaagaccgtcgacccaacggatgcctccaccaccgaggtgattcagctcgagaccgcgatgggcgctgcagtgagtctgttcaatggggcgatctgcgtcgaggtggaccgcatgcgcttcctgccggtgaaaaccaccgacgacctgttcatcatgcgctccgaccgcttccatctgaccgatcagtacgagatggaggacggcaactacatcttcccgaacgtccagcttgacacgcgcttctacaagaacatccatgatttcgacgaccgcttcccctacggcgtgccatcgcttgcagcggctgcctcggtcacggtggagggggattggaccttcggccgtgatgtgaacttctatggtgaggcgacattgcatgatgagggtaggccgagttatgtcccaaacggcgaattcgtaggaccgcagggtatagagcccgacgaatggctgtagaattgttcgcagaaaagaaaatttggtctttttcggtgtttcagtacaccatttgaggaaaaggcccttatgataatacaaggggcgtttgtgtgcgcccactttgatttaaaacgataacgatacgtgaggactaatggctgagggtagtaacggcaggcgccgcttctcggataagtggggcaagcatgagcttgatgtgctggcagtgttgtcgtccgcttttccgcaatggctgacttcccgccagatcgcccagcgtgtgaaggcatacgctgactcctacggtgaactggctgatcaggccgcgaaagcggctttcgcgaagcaattccaacgtgaccgcgctaagctggcggccatgggaatcgccatagagtcgcggcaacccgaatattcctcgaaatccgaaggtcaggatttcgcctcgtaccgccttcagctcggagacgagccccgtattcggctgaagttccagccggaagacatgccggtgctggcggccgccaactatctagcgcgatcgatgtccatgtcgtccgccccacaacctcaaccgcaacacgtctctcgcacggcaccgcgcgtgccgcagacgccgattcccggtctcggccttgattcgattgcacctggtctgggcacccagcacattcccgagaatctggtgaaggaggtggattcccgccgattcgccgccacgctttccgtgaacggcgaaagtctgaacgtcgcctacaccgacaccgacgatcttgtcatgttcgtgcttgagcacccgaacacctccattgtgaacccgccggaggccgtggacgcattccggcggcgcctcaatgccgccatcggcttccagctggccgatgactctgcgaacatgtccagcgccaaggtggcagcccatgccattgacgccggcgacgaggcggaggacgaggatggtgcgaacggcaaaggccataagaagagctcgttccagacgggaagcgaagtggatcgccgtctgcgcctcatgctgttcctctccgcccacatgggagaggaatactcgctctccgaactcgccgtgcgcttcattggcgtccccaagaatgacgacgagcgcaagaagttcgtacagacaattcacaaggacatcaacacactgaccaccgtctccgacgatggcgagatggctggcagccagttcttcgacatcgactggtcgttgctcgaggccgagggcattgtatgcgccacgaactccctcggcctcgaacgtcttgccggaatctcgccgcaatacatgagcatgctcaccgcatcggtgaactatctggcccatgcaccgctgctgcccgccgaggaacgcagccaagcggttgacctctatgaccgcctgcgccagtatgtggaaccgggtcagaccccttggctgagtctgaccggctacgaggtggaaccgcgttccttcggcattgtgaagaaggcaatcgctgagcatgcgttgctggacatgaagtacaccgatggttctggccgtattcgcgagcgtctggtggcaccatccaaaatctacgtggacgaaggcgtgtattacgtggccttgtggaccgatgtcgaagacgtcgccccggcggcgctgcacaaaatcgtgcataaggacatgacgattaacaaggagaccggagaacctcgaatctggcagatcctgcgcatcgcgcgcatagaggaggtccaggaggtggaaccgaccaagccgatgcagattccagatgtctctgtgagcgacctgcgcaaatggagcatcgagacctccacatccgccgccttcatcaccgatcaaccgcatttggagttcatacgcacactcggcgatgccgaggtggaaccgtgcggtgagggggagaaggttcgactgcagattcagtctgactcgtggttcgtggcgttctgcattgctcatgcccgccatattctggcagtggcaccggagaccttgcgcacgatgattatcgcacgcgccaagcgtgagctgagcatgctcgacgagaacggcgaggccgattcagccgaggaacatcatgcccgctgatgcggtgcgtgtagaggtatattacatgacggacggacgccatcgcgcccggtggaattgacaggacgacgcaaggaaagaggtaatgcatgccgtggtggatctggttgattctggcccttgccatgctggcggtgctgattgccggcatcatctacgtgatcattcacggactccatgcgctccagtcggtgcaacggaccggtgaggcggtctctgaacggattgccctcatgtccgataccgagggcacccgacaccccaaggagcgtcccatcttcaccgagccactcgaggtggccgccaatcgatacacgcaggcccatacgaaggtggacaaacgcaagcgggcacgtcgtgaacgctatgcacgaatctggagcaggtgggcctcattcaacgactgacgtggatggggaaaatggcaggacgaaacaaaaggaacaggcattccgagtcaacagacgagcgtgaactcagcccggccgaacggtaccgggccttcaaggagtcgaggaagcgcatgcagtctgtagcggcacggttcgcggaccgtatgccattcgagttggatgcctttcagcaagatgccaacgaggctcttgaggccggctccaatgtgcttgtggcggcaccgaccggcgccgggaaaaccgtggtggcggatttcgccatatatctggctcagcaacgcaatgtgaaggcgttctacacgacgcctatcaaggcgctgagcaaccagaaataccatgatctagtcgacatgtacggtgcggataaggtggggttgctcaccggtgacacctcgataaattccgaggccgacatcgtggtgatgaccaccgaagtgctgcgcaatatgctctacgagcattcgacaacgctcaacgccttgggctatgtgattctcgacgaggtccattatctcgctgacaggttcagaggaccgatttgggaggaagtgatcatccacctgcctcagagcgttcggatcatcggactctccgccactgtgtcgaatgtcgaggactttgcagactggattgaatccgtacgcggggacaccaagctcgtggtgtctgaacaccggccggttccgctggaccagtacgtgttattgcaaaaggatccacgcaccgaaccggagttgttcgacctgtattgcagggacgacatgggcgaacagaccgtcaaaatgaatgcacggctgatgaaccggcttgacgagctcgaccgtatggaggcgcggcgcgcgcgtgcggacacccatggtaggtcggagcggcggcaagaccgcggaggcaaacgcaagttcgtgcgcaagccggaacgatatcagcctcgccgttgggcggtcgtcgatgaactgaacttcttgggcatgctccccgccatatatttcgtgttctcacgcaatggctgtgacgaggcagtggaacagtgcctcaacgccgggttgcggctcaccactgacgaggaggctctgcacatccgcaagatcgtggatgagatgattgagggacagctcactcgtgaggacctgaagaccctgcacttctcacagttccgctatgccttggaagagggctttgccgcgcaccatgccggtatgatcgcgctgttcaagcagattgtcgagcgcctgttcgaagaggggctcatcaagtgtgtgtttgccaccgagacactggcgctcggcatcaacatgccggcacgcagcgtcgtggtggagaagctggagaaatacaatggcactggcatcgttccattgaccccgggggagtacacccagctcaccggccgtgccggacgccggggcatcgacaccataggcaatgccatcgtggtcgatcaccgcgatttcaaacccgagacggcagtggcattgtccagcaagcgcgtctacccgctgcattcgagcttcaaggcgaccttcaatatggccgtcaatctactcaactccagcgattatgagacggcacgagacaccctcgaccattcgttcgcccaatgggaagccaatgagtcggcatgggatctcgaggcacgcattgacaaactgcgcaaggccatagctggctatgaggaggccatgggcaatgatgccggtgacatggtggagctgctgcgcattcgcatgaagctcagcgacctgcagaagaacgaacgccggcggctcaagcacgaggtgttcaagtcgaatgaggagcgttcgcgtgcattccgccggctggatgcacagatcgcccagctcaaagagcaggaggcgaaccaccccgccaaacggtctgcggatttcaagaccctgatgaaatgggggcaccgctgggtgcgtgagaccaaggaactcgagcgtctggaataccgctatgaatcccgtaccagttcggtggctcgtcagttcgaccgcatatgccatagcctcgaagtgctcggttaccttgagacagccgacgagaacggtcacatcgactacaggctcaccgaatacgggcagctactcaggcgactctacaccgaacgtgatctggtattggcgcaggcgatcacccatggcatcttcgacgatctcaatgcccccgaactcgctgcagtgatgtcgtcgttgctgtacgaacctcgccgaggcgagggtggggaaccgagaaggtacccgggaggcccccgtggtcgtgtgatgcaggccgcgaacgccttgagggacatggatgggcagatcatcgcattgtgcgaggcgaacggtctggagaactatctgcaaccgctggactttggaatcgtcgatctcatgtacaactgggcatatggcgactcgctctccgaagtgctcgagcacagcgacatgaccggtggggatttcgtacgtacggcgaaacgcattgccgacgtattgcagcagatcgccgtcgccgaaccatatctgggggagggcggtgccgagctcgccgccctcgcgcatgaggcctacgagcgcgtcaatcgtggcatcgtggcttactccggcgtggactgatcggcgccaaaaccggtgccagacaccgagaatgcaaggaataaaggggtagtcccagctgttttgtagcttggaagtactttgaaacctcaaggaggaacagcatggcggaacgcagtctgcgcggcatgagcatcggcgcaaagtccttggagtccgacgacaacgtcgatttcgcggctcgcgtcgaagtggcctacgtatgtccgaaggggcaccgcaccatcctgccgttcgccgagtccgcggatcttccgaacgaatgggagtgccgttgcggcgccaccgcgcaccgtgagaacgaggaggacgagcagccggacgaaatcaccaagccgacccgcacgcattgggatatgctcatggagcgtcgtagcgaggacgagctggcggcattgctcgaaaagcgtctgaagatgcatcacgacggctggattccggactacgagtgacgacaacctgacatgacagagcatgttatgtcaggtttttcatttgcaaaacagcgtgtgcccatataggacggaaagaggaaatacatgacagaacccaggcgagtggtgttgctcgatctcgacggcacgttgacggaatcgggccccggcatcatcaaatgcgtgatcaaggccttcgaggccgtggatgttcccgtgccaaacgacgaggcattgcagcgtttcattggacctgccatcatcgattcgatgaagctcaacggcattccgccgcagaaactcgatgaggcggtacgcgtctatcggcatttctatggtgatgcgaatgtgttcaacgatccgaacgaacccgggcggaaagtgcccggccgtcttgtcaactcgatgtacgaaggcattcccgaacagctgcgcaaaatgcgcgagatgggctactatctcgcggtatgcacggcaaagcccgagtatcaggccattccgatttgcgagcatttccatctgaccgatcttgtcgacggcatctacggggcaagcaaagacaattcgcgcatcaccaaggaagcggtgatcacctatgcgctcgacagaatcggtgtggacaggaacgccggagacagagcgctcatggtgggagatcgttggaccgatgtggacggcgccaagctcaatgggctcgactgcctgggttgcggctggggctatgccgagccgaacgaattgcgcgagcatggcgcataccgtgtggttccgttcgtcagcgagcttgccgatgcggtgaacgattacttcacggaacgccagtgaccgattgacaatccaataatctcatcagaaggggcgcatgcaatacgtatacgccccttcactatatcggtataccattatccgataatgtacgttatgtcagattagatatccgtcacactccccagtgatatatatgcggtatgtcatatctagctcgttcgccaggctcagtcagattgatgaatacgcggccacaccctccgcaccagcggcggcaccgataccgcgacattcatcacgataagatcaacgaatacgaccaatcacgccacgacaaaacaatgggtcacgggaaaatattctcgtcgaacaagtcttattattgaaaacacttgcatgatacttttcaatatacttatctgtagatctgtttttacggattttctacagcacgatgtatagatatatttaaacgtgtagtaattttgtgttttcttcgatgatttaagtgcctgttacttcattattcgaaccaacgtggcatttaacaaggtttaccggaacagcaacgccttctcctccatgcattgccttggattcctccgcaactcaaacaacatcggcgtgtgcattccgccgcggaagcctgtgacccagagcgtacagcagcatgccgaggaacaggctcgccagcactagcgcaatcgcctgccaggcattcgtctgcagcagtttgtaggtatcggccgaaaaagtggagaacgtggtcagaccgccgcagaatcccgtggtcatgaatttcgccatggccttgctcggttcgcgtcgttcgatgattgcggtgaatagccccatgaggaaacagcccacgcaattgatgacaagaatcgagatcggatccatcgtccaattgttgaagccattctccagcagataccggcagacggctcccaatgcgcatccgaatcccactgcaatgagttccataatcctcacccctacgcaaacgctctggtgacaagaaaaccaaacgccacgcaacaaatgcctgccacgacgctgccaatccaatagatccacgcgcgaaccgtactgtgctcttcgaacagcgacacgacttccgacgtaaaggtggagaacgtggtcagaccgccgcagaatcccgtgatcagcaaagctttccatggctcggccacagaccccatggccactacccccagcatgatgcccacgagcaacgaaccggccagatttaccaacagggtgccgcatgggattgcgtagtccttgcggttaagccagcctgaggccaatgagcgcaaacagccgccggcgaatgcgccaacagccaccgcacttagattcggccagatcatatgattgacatcccctcatgggtctcatcaccgtctgcgtcaccatcgtcaggcaatggttcgacgtgcgccggttcgaaacgcatggcacgccgagcctgcacatacatgagcgccaactccgcgaacaccaacaccacggcaaccaccgcggagggccatcccaaccgttcgtagagcgagcgtgggtgggtgccgatcgagtccttgttcgccaggaacaggaaatacggcatggcgaacaagacaaaggtggtgagctggccgatgatcacggcccaactgactggtttgaccacaacatccgcgcgcccgaaatggctgcagtgcacggtgaccgcacacaccatgactgcacagagcgctgctgcaatccatagaatggcaggtaaggcgttcatatcactcccctcgtcttcatgcacattgatatattacgccacggcgtacgaatgcccatcgatgtccaagggcacatcgcgatacggaggctcgacgtgcgcgtcccggtgatgcagtctggtgcctttcgcgacaatcggcagacgagccaacggtccatcggaatcgacgctcaggtgccgcaaggcgacatcggaggtgacagcaacggattcggcggccgccagactggactccacctgacggaacaacgccccgacggcaatgatgaacacggcggattcatgctgcaggacatcggcgaacatggtctcaccctcacaggcgcgcacatgctccccgtcgcagacgatgaccatgtgggagagctgcgtggagcggtaggcccgcaggaactgcaatgtttgcgatatgttctgcaagttcacgccaaggtcgagcaatttcttgcatgcggcgagcatgagtacgtcgttgaaggaatacaggcgtcgcgaccccgaaccgtgcgatgcggtgaccgatggctccacgatatgcttatgcgcccagtagtcgagttgccggtatgtgatgccggccgcccgtgacgccgcagatccgcgataccccatgcgaacctgctcggtttccagcagggagtccggaaacaactccccttgcaccatggaatcgtcgacatcgagcaatgggacatccacgaaaagcgggaggccgtcattccgaccttcccgctgtgcttgtgtctcccgattcgactccattgcagggcgtgcggctcaatgctcagatgttacgcaccgcgctgttcgtgaaatagatcaggcggaacttgccaatcatgatctcatcgccattcttgagcgtcgccttgtcgaccctctgccggttcacataggtgccgttgaggctgccggcatcaatcaccgtgtaagcgccgttttcgcggcggaacacggcatgctggcgcgagaccgtggaatcgtcgagcagaatgtcggcgcgcgggtccctgcctacggtcacctcgtcttcatcgagcaggtaacgcgaaccggaaagagcgccacgtgttgcgataagcagagccgtgtcgtccgccagtctggagatggtctgcagatcctcctgcgtcaacggacgctcaccgctggtggtcactggaatctggatggcaggcatgccgatgatggtggtttcgcctgcacttggaattggatcagtcataactcctcattctacaatctttgcgtacttatagttggtcaccggctgcgtttgggtgattttcacgtcatcggacgtctcgacgttcacactcgccccgaatttcaccgtaagcctcgagccgacgccaccggccatgttcaccgcattcgcaaggttgttctgctcccctatggccttgacgatgtatggcgcgttgagtgccttgccgtcacatatgaggccattcgcaccttcgctgatgtaggtggaggtgaccacccgcacatcgttgatggcaatgacctctgcacctccgttgcgcagctcctcgatgaggttgaacatggtcgccgcatcgatcggcgccttggtgccggcggagatatgcacgatgataccgggaccctccgcgggaagccgacctgagagaatgccgctggactcctcgttctccttggcgatgcggttcgcctcggcctccttatcggctgcctgttgcagtgaagtgagctgccggctgagctcggtgcgtcgctcttcaaggcgctgcacctgcgtgttcgtctcgccgagcatacgggtgagttcagactcggtcatcgtctcatacgtcatatccgtattgttcacctggatcacgtacccgaacgacagcagtgcgcacaatgccgctacaagtacactggccagcagccgcgcgcgaatggattgtgcgcgtccggaaatctgcttcttcggtttcgctttcctgaccgccggaaatgcaccggttggcagtttgtcattctgccggtcttttttctgctgagagaggattttcttcacatggatgccgctgggtggttcaggaggcgtcccggctgactgaatcggtttgttctcgtgcccattcgcttcgcccatactcacccctggaagatgaaacggcggattgccgagacgttggagaagatgcggatgccaagcacgacgatgacagcggtggagagttgcgaccccacaccaagttggttgcccaggagcaccaggagtgttgcggtgacgacattggagaagaacgagatcacgaacaccttgtcggagaagctgcgctcgaagtaggcacgtgccgcgccaagcaacgcatcaagtgccgccaccaccatgatcggaagatacggttggagccaaatcggaatgtctggtttcacgaacagaccgactacaacgccgatgatcagaccgagcactgctgccattaccgtatctccttcgcatttgaaacctgaccgggtgttgccgccttgagtcgaatcatattctccttgctggtctgcaacgtcataccggcgtccttgaactcctggtacagtgtcgagagctccttttgccccattctattcgcaagctcgttcttattgcctatggcttgaatgcggtatggacttgaaaccggtgtggtgccaatgagtatggagttgcctgcggttcgtatggacgtctgcaccccaagcctgttgtcgttgatggagatcgcctcggcgcctgccttccacataagcgagacgagcaattgcagatcggtgtcggtgaccacgcgcaatcggttcgtcgatttctctcgaggtaacgatccttcctgcgcattgctgttcgtcaccatcgggtcggcaacggtgagcacaatgccctcgccttcgacagcggtggcgccggcagccgcttcgttgcgccgcacctcctgctccacttgggagggcaatgcggattgcgattggcggtccacatctgcgcgcatatccgcaatctgcttctccagttcgtcgatatgagtattctgcgcctcaagctgtgacgccaactgttgacgcacctgtttgcggggatcggtgttgagcaggcgcacgaacaggcatcccgcgaatccgacggccacgcatatgatgagcacgataatgcgcgtgccccagaatgtgagtttcgaatccggtttggtaaccagtctcgaatcgttgtagagggcgtccatcggacggttcactagatcgtcgatgagccgaagcgaggcatcgtagtgtttgccccggcgccgaggcggcatcaccccaccacgtgatatctcggtgtgatgtgagtcgagacgggcgtatgcggacgaaaaaacggcacgcctgcgaaccggcggatcttcaacgctcaccgggaacacttcaggcatgccgttttcgcgggtcaactgcgcgtcctctctctgatttacctacctgactgctttttgacgtccatccgcctgtaggagcccgataccctgacgcatatacaggattccggccatccagtacagtcctatgccccaaatcgcacaggagatagccgcatagtgcagcatttcgaacacgggcatctgacgttctatatcggccaccatgaggccgacgatcgagatcatgagcactgcggtgcctgtcttgcctacgaagtgcactgggagcggcccatagttatgttgcgcgagaaccacggtgagcacggccattgtcacatcgcgcaaagccacgagaatgagcatccaccaaggcaccacatggcagatgccgagtgccagaatggagcacaggatgagcaatcggtcggcgattggatcgagcaactggccgatcttgctcacctgattgaatttacgcgcaatgagaccatcgagcccatcagaggcgaacgacaacgccagcacgaccagagcccataccatgctgtgctcggtgatgagccatgcgatgatcggaatggagatgatgcgcaacagactgatgatgtttggtatggtgaacaccacgtcacgcggttccggactgtacttcttccggctgaacttctctttgagatccatgggcgtcacatccaagcgactcacattcgcgtcgcctggatggcggtgacgatgatgccgcgtgcgccgacttcatacaactgatccatgagctgattcaccttggctttcggcaccatgacgcgcaccgctgcccactgcttgtcatgaagcggcgagatggtggggctttcgaagccgggcgtgatctgtacggccgcagagatcttctccacgggaatatcgaagtccatgagcacatagcgcttggccgtgagcacaccatgcaggcggcgttcgagccgttccaagcgctcgtcctgggggtccaaccgcggcgagcgaatgagcaccgcttccgagtgcagaatcggttccccgaaaatgcgcagaccggcgttgcgcagggtggtacctgtggaaacgacatctgcaatcaaatcagccacaccaagctgcaccgaggattccaccgcgccatccaaatgtatgggcgtcgcattgatgccgtgttcggtcagatagtcatgcacaagcttgtcgaaggaggtacccacccgcttgccttcgacgtcgtcgagcgtggtgatcgggctgtcctgcggagcggcgaaacggaacgtggatcctccgaaaccgaggttcatctcctcctgcgcatcagttcccgagttgagcagcagatcatggccggtgatacccacatcgatggtgcccatgcccacgtacactgcgatgtccagtggacgaaggtagaacagttcgacgtcgttgtcggggtcctccaccaccagttggcgtgggttgctccgcaacgtgtatccggcctcagacagcatggcccatgccggctcggaaagcatgcccttgtttggcactgcgattctcagcatgattcctccaacttcctccccacgcttgcgccgcatgcgaccggcgccccggcgggtatttgcttacaggttcttgtagatgtcgtcgagagtgatgccacggtcgatcatcatgacctgcagatggtagatgagctggctcatctcctcggcggtgcgctcggcaccctcgtattcggcggcgatccaggtctcgcccgcctcttcgatgatcttcttgccaatgaaatgggtgcctttgccaagttcgtccacggtgagtgaacctggggtctggttggcggccttttcgctgagttcggcgaacagcgactcgaatgtcttcatggtttccttaatcgaacgtacacgtgctacccagtgtggcacgtggtatgggcatgaatgtgccgcacgccgtttcgacgtgcggcaagttgcgaatcagtcgcggtaggcggcggcggccgtgtcgcgaatctcgttgatcgccttggctggatcagcggcgccatagaccgcggatccagcgacgagaatattcgcgccggcctgggccacggttgccgccgtcttcggactcacgccaccatcgacctgaatgttcgtgtcaaggccacgacgtgtgatttcgtcacgcaggcggcgcaccttgcccatctggttggcgaggaacttctggccaccgaatcccggttccaccgtcatgatgagaatggtgtcgaattcctcgagaatgtcgaagatcggttcgaccggctcggcgggacgtacggcgaaccatgcctcgcatcccatgtcgtgcagttggcgtgccagacgcaccggcgcatgggtggcccccatgtggaaggtgaccgaatgggcgccacgctccgcatagccgggagcccagcggtccggatcgtcaatcatgagatgcacatcgaccggcagatcggtgacctcgcagatgcgcttgacaaccggttcgccaatggtcagattcgggacaaagtggtggtccatcacatcgacatgaaccatgtccgcattcgaaatgcgctcgaggtcgcgttcgagattgcagaaatccgcggacagaatgcttggtgcgattttaatatccatggttgccattctaaatacagtaatcgaccaggtgagacgtctgagcggccatattcagcccgcattgcggccggagccacctgcatcctgcggcgactgctcccgtctggcttccaattcggtctgggcatgcagcttgtcgctgagaagctgggtgggacttcccactcgctggatgacgatgaaggcgacggctccgagcatgaacacaatgatcgacacccatacgttgacgcgcagtccgagaatctcgtgggagaagtcgatgcgcagcatctcgatccaggtgcgcccaagggtgtaccacatcacatacagcgcgaacagggatccggccttgagcctgttcgcaagtcggtggccgatccagatgatcagggcggctccgatgagattccatatcatctcgtacaggaaggtcggatggaacagcgtgccggtcgggcagctcgcaccgtcatagcaggtctcactgttgcctatggcactgccgttcatgttgagcttgagcccccatggcagcgtggtgggcttgccgtacagctcctggttgaaccagttgccaaggcgaccgatcgcctgggcgacaagcagcgcaggcgcaatggaatccgccagcaatgccatcggataatgcttatggcgacaccatgcccatgcacccagtgcgccgcataggatggcgccccagatgccgagaccgccgttccatatgcggaacatctcgacccagtcgccattcgggccgaagaaacgttccggagtggtgatgatgtggtagaggcgtgcaccgacgatgccacatggcaccgccaccagggtggtgtcgaagatctggtcgaaagtgcctcccaatctcttccaacgttcgccggtgatccataccgcggcaatgatgcccagcagcatcgtcaacgcatagatgtgaatcgtcagcgatcccacatggaattgggagatggatggcgagggaatgtaggcaagagtcgtcatacgctcgaatatagcgtggagaaccgatatcggcataggaccggtattggttggcagccggattcattgtcccggccgccaaccaatagcgtgccgctacaggcgtgcgttgtggatgccctcggcgagttctgcggtcttggccgccaacgcagccagacctgaggtgagctcgcgcgcatcgccatcctcggtgagcagggtgtggaccaaggcggatccaacgatgaccccgtctgcatactgcccgacggccttgccttgagcagcggtggagacgccgatgcccacacacacattctcggccccggccttacgggtccgggccacaagatcctccggggaagtccctagactcgaccgttcgccagtcacgcccatgcgcgatgccgcatagacgaatccccgggcgttttcacacaccacccgcagacgctcatcggtggagtcgggggaaacaaggaagatgcgatcgagcccatggcggtccgacgcctcgatccactcccctgcctcgtcgggaatgagatcgggagtgataaggcctgcgcctcctgcattcgcgaaatcagcggcgaagcgttcaaccccataatggtagatgaggttccagtagctcatgatgagcggcactccaccggcattggccaccgtctccacggccttgaacacatcggctatgcgctcgccattgttcagggcgatctggctggcggcctggatcaccgggccatccatcaccggatcggaatacggcagtcctatctcgacaatgtcagcaccgttctcgaccatcgtggcgaaggcctcgagtgactgttccatcgtggggaatccgaatggcaggtacccaatgaatgcaggcttgtcctgcgctttgaaccgtgtgaacagctcgcggcatgggctgggacgatggctgattccaagcggctgaccgcttggcgtggtgttgtattcggtcatatctgctcctattccacttactcgttcacgcgttgttgccggtcgcaccgttcgcctcgagtgcggctgcctgctcatcggtgagatatccgaaccacttgccggcggtgttcatgtccttgtcgccgcgtcccgagatgttcacaatcatcaccggatgctcatagcccttctccttgagatcccgtgccgctttataggcgccggcgacggcatgggagctctcgatggctggaatgatgccctcggtctcgcacagatccttgaacgcgttcatcgcttcctcatcggtcgcccatgaatagttcacacgtccgatttccttgagccatgcgtgttctgggccaacggacgcataatcaaggcctgcggaaatcgagtaggtgtcaagggtctgtccctcagagttcccaagcagatagcttttggccccctggaacatgccgagttcaccggttcccggtgcgaaacggatggcatgctggccggagtccggaccgtggccgccagcctcgaaaccatagaggttgacgcgcggatcgtcgaggaaggcgttcatgatgccgatggcattggaaccgccgcccacgcaggcgcagatcgcatcgggatgatcgatgccgtaccactgtgccagctgctccttcgcctcctcacctatgatcttctgaaagtcacgcaccatctccgggaacggatggggacctgcgacggtaccaagcagatagtgggtgtctttgacgttggtgacccaatcacgcagcgcctcgttgatggcgtccttgagaatacggtcaccaagtgtcacttcgaccacctcggcgcccagcatgcgcatgcgggccacgttgagcgcctgtcgccgtgcgtcgatctgtcccatgtagatgcggcacttgagaccgagcatcgcacacacggtggccgtggcaacgccgtgctgtcctgctccggtctccgcgatcacgcgggtcttgcccatgcgcttgacgagcagtgcctgcccgatcgcattattgatcttatgggcaccggtatggttgaggtcctcacgcttgaggaacactctggcgtcgagtccggtgcgttccttgatgcgttcggcgaatcgcggcgcctcggtgagcggtgaaggacgtcccacatagcgcttattgagcgtggcgagctccttgtggaattcgggatcatctttcgcgtcgtcgtacacacgctgcaattcatcgagggcggtgataagcgcctccggcacatagcgaccgccgaactgcccccaatacgggccatgatgttcgctcaacggagtggtttcagaagctttcactcgttctcctgccttcactaatcgttccacggccagccgcgggtcatcggcggtggccacgccctctcccaccagaacagcgtcggctccggcgcgggcataatcctcaacttcaacggcaccgaatacaccggactcggccaccttgatcacatcttcgggcagattgctcgccaactcggtgtatttgcccacatcgacgcgcaaatccttcagattgcgcgcattgatgccgatcacacgcgcgccggccgcgatggcccgctcgatttcctcacgggtatgcgtttcgaccaaggcggtcataccgagttcatgcgtgagcttcagcagatgcgccagctgggtgtcgtcaagcgccgcgacgatgagcagcacgatgtccgccccatgcgcacgcgcctcccagatctggtaatccgtggtgatgaaatccttccgaagcaccgggatgtgcacagcggcacgtacggcatcgacatcgtcaagagacccgaggaacctgcggccttcagtgagcaccgagattgcgctcgcaccgccttgttcgtattgtcggcccaaagcggcagggtcttctatatcgatgagatgccctttcgacggcgaggcacgctttatttcggcaatcaccggaatgccgtcgtgacgcctaagccatcgtttcgcgtcgaggggagccggagccgaggcagcccgggccttgagctcttccaacgacgttacgcgttcacggtcgcacttgtcttcgagtgcccccgctaccagttcatccaaaaccgacatgctcctccttgggatgcgatggctcaacgggcccttcccgtcatagtcactgtaacggaatgcaggtgacgaacgcatgtcgacgtctgaatcgtggtctgttccttctcgccggcgacatacggctcgacgcataacaccgaatcacacacggcgagggaattacgctcaaaagcggaatgccatctatgcattcgcaaatggtggtctaattagacatagcctacatcactgatgaaaggaaccgattatggcagacatcaaggaacatttcgaggaattcaaggatcgcatggaggagaagcacgaggagcacaaggcggagcgtgacgaaaagcgcgccgagcgtgccgaggaccatgctgccaaggtgattgccaaggaggacgagaagatcgtcaaggccgctgacgacccggatgccaagctcgagaagatcaccgacaaggccgatgacaagaaggacaaggccgaaggcaaggcagccgccaaggaagccaaggccaccgaggatcaggtggagctcaacgagcgcttcggaacccagctcggctgattccgctccacattttccggctgaaagggacgtgcatgcatgtccctttttcatactccactggacccccatagcaggtatgtccggggcccacaccgtgcacgaatcccccattgctctcgacgaacaatccgtttggtaatttgccgaacatgctgtaatggatggagtgccatacaggcacacacaaacgaaaggagccaatcatgagtgatatggctcaaaagataggtgaactcaagggcaaggccgaagtcaaggcagacgaggtcaagatgaaggccggcgagctcaagggcaaggccgaggccaagctcgacgaactcaagaaggatcacgaggaccagtccaagtgacatcgcgtcaccagaccgcttcgaatccaatgaaaggcgtgaacctcaggttcacgccttttccttttgaaccgcagagcgttccgcatgacgccgttggcagaagcgggccacgtttccgcgccggtttgcccagaacgtgctaagccggtctggtggagacatgctaaggagtgtatatggatacgattgaatcgataaccaagcagatcatggacgacccgcgtgacgcggagttcacgaagcgcggtgagaagccggttttctcggcgccgtccaccgcgctcatcacgatagtcgggcaatcaccgagtctggacgcgcagacgcgcggcttgtgctggaacgaccgcagcggtgacaccctgcgcaaatggctcgatgtggacaaagagacgttctacgattccggaaaattcgcactcgtgccaatggacttctactatcttggcgacgtgcctggagacaagggcatggaggagccgcgcgagtgggtcgccccaacctaccacccagagatcatgaagctgctgccggatgtcaagttgacgattctggccggatcgaatgccgtgaagtactacctcaatcaatggtcgaaggcgcgtcttgaggacacggtgaagcacttccaggaatacctgcccaagtacttccccatcgtgcatccgtcgggccggaccgacatctggcgcaccgagcatccgtggttcgatgagacggtggtgccggcactgcgcgagcatgtgcacgccatccttggcaagtgagaaatcactcgattctaatgacgtaagtcccccgtattcgttgtgacgacgaatacgggggacttcgatatgcgggcgctcacacctgtttgagttgtgccgcgattttgatcgcctcgacgctcgcactcgctttgttgcgcgtctccatccattcgttctccggaatggagtcgagcaccagaccggctcccgcctgcacactcgccttgtgatcgcgaatgaacgcagtgcggattgcaatggccatgtccatattgccggagaaatcgaaataaccgacagtacccccgtatatgccgcgatccgctggttccatctgatcgatgagttcgatggccttgggcttcggcgcgcccgacaacgtacctgccgggaatgccgatgtgaacacgtccatcacggaaagtcccggcagcacacgtccggtgacggtggaacagatgtgcatgatgtggctgtagcgcaacacatccatcagggaaaccacctccaccgagtccggctcgcagacacgactcagatcgttgcgggcaagatcgacgagcatgatgtgctcactgcgctccttcggatccgcaagcaactcgtcatggagacgttcgtcctcctccggggtcttgcctcgcgggcgtgaccccgcaatcgggaaactcatcgccaatccgttgtcgactttgatgagtgtctccggagaagatccgatcacgttgaaaacgcggcccttcgcatcggtgagcgtcatgaagtacatgtatggactcgggttcagcgtgcgcagcacacggtagacgtcgaagggatcggccggcgaatcgatgtcgagacgctgcgaccccaccacctggaacacgtctccgtcgatgatgtgccggcgtgatcgttcgaccatcgcgatgaaatcttccttcgccgtccggaagcgcagctgcggttggggaatggatgtgtctacgacgttgacgcggaattcgtcctgcgccggagtcgcggcctggatctccatctgcccgacgcgcgcaaccgcttcgttgtaagcggcatcggcacgggtcggcttgtcgtccacgttcacggcgtttgcgatgagccacacggatcccgtcttgtggtccaccacggcaatgtcggtggccaaagccaacgtgagctcgggctgctcggtctcatcgggcgcattcgcaggcaacgtcggttcccaatgccgaatggcatcccatccgacattgcccaccagcccactggtcagattcggcaggccctccactttcggcgatctaagcacatcgagtgtcgcacgcgccacatcgatgacgtctccggtgagaggaacaccgacaggaacctttcccagccaatcggcctcgccttgattcgaacgtaactgggccatggaattgacgccgatgaagctgtactgactccaggtgccattagtctcggcggattcgagaatgaaggtccccgaccggtgccctgcaagacgttcatataaccccacgggggtcaacgaatcggcaaggatcctgcgtacgatggggatgatgcggtacccttcaccggcaagttcatggaaccgctcgcgcgacggccaggtttccccccaacccagattcttcacactactggagtcctgcatgctcactctgtctcctcccgaggttcgcgctcgcccatgaccaccggcaacggcccaccctcgtcgaagcagctgcgcttgccggtgtggcatgcagcacccacctgatcaacttccacgagaatggcgtcgccgtcgcaatccaggctgagacccttcacatactgcacatgaccggacgtgtctcctttgcaccagtattcctgccgcgatcgcgaccagaacgtgactcgaccagtggtaagggttcgacgcaatgcctcatcgtccatgtaccccaccatgagcacctcatgggtatcgtattgctggatgacggcgcagaccagccccttgtcgtcgtatttgagacggtccttgatacgcggatccagcgtcttggtgttgtcgtatacgatttcagattcataactcatgcctgctccaatgctgtaggcgttcattcaattggtggccggggagcatccagggcatcccttcggcctctctagcgcacggcatagccagcacggcgcaactcgtccttgacctcgccgattgtaaccttgccgtagtggaagattgatgcggcaagtacggcgtccgcgccggcggcgatggcaggcgggaaatcctgtgcctttcctgcgcctccggaggcgatgatcggaatagacaccacctcgcgcattgcacggatcatctccagatcgaagccctgctgcgtgccatccgcatccatcgaattgagcagcacctcgccggcacccagctcctcggcacgcctcgcccaccacagggcgtcgatgccggtggatttacggccacccatcgttgtgacctcgaatccggattgcgtatgctgctccccacgctcacgccgggcatccaccgacagcaccagcacctgattgccgaaacgctcggcaacgcggctgatcagcgtcggatcgttaatggccgcggtgttcacgctcaccttgtccgcaccgcagcgcagcaacgaatctacatcttcgggcgtgcgcacgccccctccgaccgtgagcggaatgaaaatctgttccgcggtgcgcgtgacgacgttaaccatagtctgacgatgcgagctcgaggcggtcacatcgaggaacgtgagctcatcggccccctgacggtaatactccgctgcgagctccaccggatccccggcatccctgaggttttcgaaatgaacgcccttgaccacacgtccgtcatcgacatccaggcagggaatcacacgtaccgccaacgacatgctcatgctctccgtttcatcttgggacttgcataccgtgctctagagtaccgattccctgttacatcgccatgtgcttgctatggggcgcccatattgtgatatcgcgaccctgcatatattcctcaggaataccggcaactaccggttcacattgcgtttgcgcagaccgaatacgatgaccgcggcaagccagaaccccacggcatacgcagtcacaatccatacatgcggccagattctcccgtagtcgccgcccacagccgctacagcggactgcgcggcattgtagaacggcaatgccttcgcaatatcctggaatgtcggtcccatgatctgaatcggcaccgtgactccggcgagaatgaacgcgattgtcgtgagcatcgcgccgcacacaccacccacggccttgtcgctcatcagcgtgccgcacagcaagcctatcgccgtgtacatgagcgccgtcggcaaaaccacaatcgccccaagcaacatacgcacgccgatcggatggccgaatagcccggcgaacaggaacgtgacaagcgactgcgccagcgccaccacgagcattggcagcgaatacccgagagtgaaatccgcggcggtcatcggcgaggcgaacaggcgtgtaagaaatgacgacgtgcgatccttggcgatcagcatgccggagaacaacgagacgaacaccggcgcataggcggagatggccgcggccagctcatcgccggagattgtcgcagcacctggaatctggcccacctgcttgtatatcaacgacaatgcccacagcaggagcaccggaaacgcgagaccgaagaacagattcaccggatcgcgcatgatttccttcatggtgcggcgcgcgaacaaccacgtcctatgccagctcattgttccctcccaccagtttcacgaatgcgtcttccagattgttttcaccggtttgcttcttgagctcggccacggtgccgatggcgatggtcctgccggcgaccatgatggcgatacggtcggccagcgcctccacctcttccaggtaatgcgtggtaagcagtatcgtcacccgccccttaagccctttgatcacattccacagctcacgacgggcgaatatatccagtcccaccgtcggctcgtcgaggaacagaatcttcggattggtgatgaggcccattgcgatgctgagccggcgttgcatgccaccggagagcgtgtgtgctttctgggaggccaccgcattgagtccgaattcatcaagtgcctgctgtgtgctcgccttggcctgctgcgctgactgcccatagattccggcgatgagcctgagattctcggtgacgctcagattcggcgccacggccgtttcctggggcgagagattgatctgcggcttgatgcgcttcgcatcggtcagtaccgattctcccagcaagtatgcgttgccgctcgtcggtttggtcaatccgcatagcattgagatcgtcgtcgtcttgcccgcgccgttcacgccgagcaatgcgaaggtctccccctgcgccacggtgagattgagcttgtcgactgcggtgaggctgccgaaggtcttggtcaggtcgacggttcatatggcgtccatctcactccccctgtttcgtttccgtgtactcgctcagcgcatggaacatgtcggaaagggaatgttccgcgaatgcctcgtcccagtcgagataaccggtgacgatcattgaggcgatgccatgcacatacacccacattcgcatatggaaggcataggcttcgtcataccccacacccaattgcctggcgatgatttcgatcaccggacgcagttggatgctggattgttccatctgctcaggtgtgcgccgatgcatgaacagcaacgtgaacagatttggctccgtgcgcgcgaactcgatgtatgcgagaccgctggccagatatggcggtcgatcaccggcactcatcgccgcatcaagcctctcgatgtaccacgcattcgcctgttcccaaacggcctgccgcacctcgtccatggtgtcgaacaggccgaagatcggcttgaccgagcatccaagcttctcggcgagggaacgggcagtgagggattcctcgcccccaccgcgaacaatgtcaaacgcggctacggcgacctcctcctgcgtgaatcgtggtggacgcggcaatgcaatctcctcgatctattaagtaacatatgttaccttacaagagcagactgcttatgtcaagttgggcatgaaaaagcgacaccgaattggtgccgcctgaaccgagaatatgcccattatgcgttgttggttttggccgcaagctggccgcacgcaccatcgatgtcctgcccacgggtgtcacgcaatgtggcggtgatgccggcattgtgcagaatctcgaggaaccggcgctcgtcctcgggcttcgatgccgtccacttcgatccttcaatgggattgagaggaatcgggttgacgtgggcccagttgtcaccgtaatggttgagccggttcgccagttgacgcgcatggatctcctgatcgttgatgccccgcatcaatgcgtattcgatgctcacgcggcgtttgctcgccagataatagtcatgtgcggcatcgagcacttcatccacattgaagcgacggttcatcggcaccaactcatcacggagcgcgttgttgggggcgtgcaacgagaccgccaaccgcaccggcatgccttcctgtgcgagtctgcgaatgccaggaaccacgcccacagtcgatacggtgatgttgcgtgcagagatcccgaagccttccggaggcatcgcgctgatctgtcggactgcggaaacaatcgcccgatagttgcccatcggctcccccatgcccatgaacacgacattgctcaatcggccgggacctccggccacttcaccccgttccatcattgcggcggcgatgcgcacctgttcgagaatctcgccggtggacatgtttcgcgtcaaccccaattggccggtggcgcagaaggggcatcccatgccgcaacccacctgcgacgagatgcacaacgtggtgcggttcgggtaacgcatgagcaccgactcaatcttcgaaccatcgaacagctcccacagagtcttgatcgtctgcccgtcatcagcgacctgccgggtcacttcgcgaatcaacgtcgggaagaattcacgcgccacctcatcgcgtttgcccgcggggaaatctgtgaaatacccagcatcggcgtcaaagtgcccatagtagtggttggcgagctgccggacccggaatttgggcaatccgagctccttcgccttggcgatgcgctcatcgtccgtcagatcggcgaaatgaaccggcggtttgccgcggcgcgcgtggttcttgctgagtacgtcacggaatgcgccactgcggccaccttcagtgatgccggtctcgacggtctcggaaacctgattgtcgtcagtcactctgaaatcgctcataatccttattcgtctacagtccagttgcccacagcaatacgcatatgaatggcgcgcacatgaggatcgaatccacacgatcgagcacccctccatggcctttcaacatatgccccatgtcttttatgcccatatcacgcttgagcatcgacgcacacagatcaccataggtgcccacaatgcctatgatcacgccggtcaacaacggcgcccaccaacgcgtggcccacaacgccggctcataggtgcaggcgaatacggcataggctccggccaccgcgaagagcatggatccgcacagcccctccacggatttcttcggagagatgcgcggactcagcttgtgcctaccgaacagcatgcctgcaaacaagccaccggtgtcgctcaacgccggcatgaacacaatcaacatcgcgtgggcgaaataatgctcgttgaacgtcaggggcatcacgatgcaggaggccagcagtgggatgtacaacacggtgaacatcgcgacagccacctgagtcaggtggctgtgttgctcggtgcgacgatcgggcgcatctggcgtggtcagggccttgttatcgagctccttctccacacgacgcccatgccagacctgcagagtggcgctgaatgcgacggctatgagcgagacggcaacacagaccgccatggccacgacgtggcgtgggtagaagtacaccgccagcaatgtgaccgtggaacagatccatagtgtgacaagcggaatgtgcaggttaatcgtcgcgaagtccacgcgcaattcccatagccccgcgatcatgaacagcaccaccagcaccacgaacagtatgggacttgcccataggcatagcagaatgatggcgatgagcgcgatcgccgtacccactgcctgtggcatattgcggccggcttttctattgatcgcgttgattgcctcgtcggccttggcttccctgtcgcgctgcatttgtgaatccatttccctacgccttactcatgacgtgaccactcaagatgaaaggcaatggcatgctggatatgcacaccattgccttttggaccatctggagatcagacctccatgatctccttctgctttgcctccagcaatgcatcgagctcatcggtggtggccttcgtcaccttgtcgagttccttgagcaggcgatcgccttcgtcctcgcccatctcgccatccttgacggccttgtcgatggcttccttggacttgcggcgaatgttacgcacggcgaccttgccatcctcggccttcgacttggcgagtttgacgtattccttgcggcggtcctccgtcagttccggcatcgtcagcagaatggcggatccgttgcgacgtgggcttgcccccagatctgagtcgcgcagggccttctccactgcattagcctgcgaggggtcaaatggtgtgacggaaagtgtgcgaggctctgggacaccaatggtggccacatgcttgaggggggtgggagcgccatagtattccaccacgatgccgttgagcagagcgggattggctcggcctgtgcggatgcctgcaaagttctccttggtggactccaccgacttcttcatttgttccttggattgatctacaacgtttgccatatgcatgctcctctagtttttgctgctacgtgtgttcgtcaccgctggcgactacgccagcgaggaatctccattggacaccagtgtaccgatggaatcgcccatcagcgcgcgggtcacattaccttcaccttccaagccgaagacgcgaatggtctggttgttgtcacgggccatggccattgccgaggcatccatgacggccagattgtcaatgagcgcgcgcttatagctcaacgtttcgaaacgctgggcacttggatccttgcgaggatcggcggtgtacacaccgtccacgccgttcttgcccatgaggacctcatcgcaatggatctccagcgaacgttgaatcgacacggtgtcggtggagaaatacggcatgcccgcgccggcaccaaagatgaccacacgacctttctccaaatggcgaatggccttgagcggaatgtacggttcagcgacctggcccatggtgatggcggtctgcacgcgtgtcgcctgtccggcctgctcgaggaaatcctgcagcgccaggcagttcatcaccgtaccgagcatccccatgtaatcgccgcgggaacggtctatgcccgcctcctgaagttcggcgccgcggaagaaattgccgccgccagtgacgatggccacctgaactccctgctccactgcgggaacgatttcaccggcgatgcgacggatggtcgcagtgtccacgccgactttgccattgccgaatgcctcaccggagagtttgagcaatactcggcgcggctgtgccaagtcgttttccaatgccatattctgccttccgtttgctgcgccttcgcgcagtcactattgtctacagggtatccatgcacgcagacaccgtaggcatatgaaaacgggggacgtggaattccacgtcccccgttttcatatgtatgcgaaatcagtcaagatcaggcatcggcctcaggagccttgccaacctcgagacgagcgaaagcgagagcctgaccgccgacttccttgaacagatcaccgatcgtcttggacggatccttcacataggcctgctcaagcagcacattctccttgaagaaggcattgagacgaccctcgacgatcttcgggacgatcttctccggcttgccttcggcaagggacttctcggtggcgacgcgccgctcggtctcgacgacgtcctcgggaacatcgtcgcgggtgagccactgggcgcccatggcagagatctgcagggcggcctcatgggccacggcggcaccggcctcatccgtggcgatcatcgcgacgatgctcgggggcatctcaacggacttcttgtgcgcgtagatctcgaccttcgggccttcgatcttggcgaactgaccgaccttgacatgttcgccgaagagcgcggaagcttcttcaacggcttccttcacagtgccgtcctgtgacggggcggcgagaacggcatcgatgtcatcggcaccggccttgacggcgtccgcgagcacggtgtctgcgaagtcgatgaacttcggggtcttggccacgaagtcggtctccgagttgagctcgacggcatagccggtctggcccgccgcggaatcgataactgtggaggcgatggtaccttcctgggccttacggccttcacgcttgccggcggcctgaatgcccttggcgcgaatgatttccttggcgcgtgcgacgtcgccgtcggcctcggtgagggccttcttgacgtccatcatgccggcgccggtctcctcgcgaacctgcttgatcaaagctgcagtgattgctgccattgatttctccttgtttgtgtgaaaagcatgggtggtgggcgcaaccttgcggcttacgcccaccaatgcaacagcggcggaaggcaaaagcttcccgacgccgtagagatcattcgacctcttcgcctggcttggccacagcctcttcgttctgggcgtcggcacgtgcggcttcggaggaggctccctcctcctcgtcggtcttcttcacctcattttcggtgaccacggcgttttcacgcagggtggccttctcgttcttctcgaggagttccttctcccaagcggccatcggctgctcggagttgctctcgctcttggaggcgttgccggagcgctccagcaggccctcggcgaccgcgtccgcgaacaggttggtgagcagttcgatgcctcggatggcgtcatcgttggccggaatcggatactcgacggcttccggatcggcgttggtgtcaacaatggcgaccaccgggatacccagcttgtgtgcttcctcaacggccagggcttccttgttgatgtcgacgacgaacatcgcggaaggagtgcgggtcatgttgcggatgccgccaagctgacgttccagcttgtccttctcgcgcttgagcaggaggagctccttcttggtgagaccggagccgtgcacgtcgtcgaagtccatcgtctcgagttccttgagacggttgacgcgcttggaaacggtctggaagttggtgagcatgccgccgagccagcgttcggagacatagggcatgttcacgcgggtggcagcgttcttgatcgcttcctgagcctgcttcttggtgccgacgaacagcacggtgccattgtgggcgacggtggtcttgatgaagtcgtaggcgacatcgatcagatccagcgtcttgaacaggttgatgatgtagattccgttacgctcggtaaggatgtactgcttcatcttcgggttccaacggcgggtctggtgaccgaattggagaccggccttcagcatttcgctcatagtgatctgagccatggtattactaccttcctagtcggttattgcctggccatgcgatcctgcgtgcagctgcccctacagggctgccgaccgacacaggccgtcgcgggcatgacgcgaattcatgtgcaccggtagacgatattcggttggctcggaaagctgcgactgccttcttcaccggttggcgcacaatgctcgataataccacagggggtcgcatttcaattgcgaccccctgtggacattcacaccagacgttcccgctgcgttcggtatggctagtcagcgctattcaagactgcgcatgcggcgcatcgccgcacgccgctcgtccttctccagccggtctatatagagatggccgtcgagatggtcggtctcgtgctggagcatacggcccatgatgccgtccccctcgagcacaatctcattgccgtccagatccatgccgcgcacgcgcgcgtaatccgcccgcttggtcttgtaccatagtttcggcaggctcaggcatccctcatcgccgtattgttcgccccgggtctcctcgagcaccgggttgagcacatagccgatcttgccatcgatgttgtacgagaaggctcggaggctgacgccgatctggttggcggagacgcccgctcggcctgggtcatccacagtatcgagcagatcctgcacgagattgcgtacggccggcgtgatctcggtgattggatcgcatggcgtgcgcagtaccggatcgggaacgacccgaatttcacgaattgccactcttgtcactgctcctttgtgttctgttcggaggaatccgaattcgttgtggttgaggcaccatgctcaggcttggccgaggaggcttcatcggaccgaccatgctgctgaagctcctcaaagcgttcctgtacattgtcgaatgcctgacggaccttcggagtgaccgtctcggcggtgtgctgcacggcttgggaggctttcttcacggtttccgaggtgctttcgatgatctgcatgctcaccggaaccggacgcgccgcattcttcggagcatagagctccgcatcgatgagctcgctgtatgtcgagagcaccttgggacgcacaactttctggcttggcgtgagcgtgccttcctcaatgctgaaatcggagggaagcacgatgaacttgcgcaccgactctgcacgggatacattggcgttcgctttgtccacgtactgctggatgaatgcgtggacaccgtcgctgtgggccagatcgtccatcgaaagattcgtgggcatgccctgattatcgagccagctgcgggtcatctcctcatcgagggtcaccactgcgccaatgaacggcttgttgtcaccgacgaccaccacatgggacacgatcgggcattcactgattgcgctttccagcggggccgggctcacgttctttccacccgcggtgatgatgagatccttcttgcgaccggtgatgtacaggaatccgtcgtcgtcgatatacccgagatcgccggtgtgcagccaaccgcttggctccagcacttcatcggtcagctccgggttcttgtagtatccaaggaacacgttggggcctttgacctcgatctccccgtcgtccgccgtacgcacggccattcccggtccgggacgtccgacggatccaacgcggttggctttctgccaattgacgatcatcggagcggccgtctccgtcatgccgtacccctgaatgaaggtgatgtcatcgatgccattgaagaaatgcacgaggtccggattgatcggcgctccgccacacgcgagataccgcaggttcgggccaagggccgatcggaaggacgaggccacggtgctcatatagaacgaatgcttgattcgcatcatcggtcccgggtgtttgtgttccgacatcatcttcgacccggccttctgggaagctgcgttgtaaaccttctcgaatacgcggggcacaccgagcaagtacgtcggcttgaagccacgcagatcggccaacagatgcttggcgtcgggcacatagcccaccaccccataacctccgatggccacatactggatgtaacgcgcgaagcaatgggcgagcggcagaaacagcagcagacggttcggggcatcgtacagcatctcgggcaggatctcgtagccgttcttcacaatgtgggtgaagttgcgatgcgaaagcatggcgcctttcggcttacctgtggaaccggacgtgaacacgatggtgagcaggtcatcggcacgcacccggccaatggccgcatcaagctcgtcctcgctcaccgattcgccgtaatcgatgagcgcttccaatgcaccgttctcgaagttgaatacgtggcggaggcatttgacctgctcggcgatgcgttccaaagtatgggtatggttctcgtcaccgccgaatgcgatggcaggctgcacctccgtgatgatcgagtcggcctgcttctgcgaatcggtctcatagatcggaacactcaccgcaccaatgctggcacatgcgaaatccatgaccccccactcgtagctggtggcggaatagattgccaccatggtacccggacgcgcccctatggccatcaggcctttcgcaacgctgcgcacctgggccagcatctcaccggccatgacatcgacccattggttcgtctgagggtctttgaactgggcaatcagttcatcggggcgttccaaagcacgtttcgacagcagctgatatacggtgtcgtcatccgtggtcacgtatttgttatcgagtccatattccctgagcatggttcaactatatccaatcgtctgccatttcatcggatggtgtcaagttcatcccatatccagataggtgcatatccaagcactgccgcgaaggtcgagcaccatgttcacccaatattggagggaacccaccctcacctcgatggtgatttcgaatctcatcggagacaccgcggtgccgtcgatgagaacaggcatgggttgcccatagaaacgcttggaatgcaaatcgacacggctgctggtggcggacttcataagatcccgcatgagttctaacctctcgcagcaggtggtggtgaccatgcctctcagcgcctgcacccccaccctgcctcgcacaacctcaaacgctatgcagcagatcttgaaagcacgttcgcttatgccatatgccgtgatgggcagcagttccacattgacgcagctgcgtatgcggaaccgcaccgggcataggctgtgattacgtgagagcatgccgctgtgcaccggcaacggtgtgcgttctatgtgcatgtccacatcgggagggcatgtctccagctcttccttcagcggaggaatgtctatgggttgacgcgcattgcccgcatgtggtttcgtattcgatgggttggatggtgtatgcatgtttcccccttgagtccgatacggtcccctttgccgtattcggtatcgaatgtatcgaagccacgattatcccgcaaccctgacacggggaattgtggatttgtggatgatttattcacattcctcccgcatcctcgccgcggcgcccttccccccgataatgccaaagcgccgagcctgatgagatggcagactcggcgctttgatgttcccattcaggatcggttggcggtgaccaccacggggcatcgttggaagctcttgatgtccacatagccacacgatgccatggcacggcgcaatgcacctatgaagttcgtggtgccgtccgccttgtggctcggaccatacaaaatctcttgcagggtgccaaccgtaccgacctcagagcgcaggccacgcggcaatgtggcgtggcgagcctcggaaccccaatgcgttccatgccccggcgcctcttgggcgcgggccagcggcgcaccgagcatggccgcatcggctcccatggcgagggcagtgacgaagctgcctgattcgcccatgctgccatccgcaatcacctggacgtatcggccccccgactcatccatgtagtcacgtcgcgcctcggccacatctgagatggcggtcgccatcgggatggacaccccgatggtctggcggttggcggatgtcgcgacgccaccgaacccaaccagcacaccggcagccccagcacgcatcagatgcaatgcagcccggtagtttgccgcaccgccgactatcaccggcacgtcgaggtcgtagatgaactgcttgaggttcaaaggctcatgatccttcgaaacatgctccgccgacacggaagtgccgcggatcacgaacaggtccacaccggcattgagcacagtcgaatagtactgctgcgtgcgctgcggggaaagggcacctgccacggttacccccgcatcgcggatctcgtggagtcgttcaacaatgagttcgggcttgattggctccgcataggcttgttgcagatacgccgtggcatcgtcgggatccaacgaggcgatcttctccagaatcggttcgggattctcgtatcgggtccacagaccttccaaatcgagtacgccaacagttccaagtttgcccatggctatggccgtctgtgggctcgtcaccgaatccatcggggccccgatcaccgggatgtcgaattcataagcatccacctgccacgaggtagacacgtcctgcggatcgcgggtgcgacgggaggggacgatggatatgtcgtccaagccataagcgatgcgggccttcttgccaaggccgatttctgtttcctgagccatgcctttaggctatccgtgccatgtgacacgtcacccgcaccgtttgcagaatggacaaatattcatgttggtaacacttttgcattacacatgggtttgttacccgcaacgactggaggacacagcatggccaaaatcaaggtcgaaggcaaggtggttgagctcgacggcgacgagatgacacgcgtcatctggaaggacatcaaggatcgtctcatactgccgtatctcgacatcgatctcgactattacgacctgggaatcgagaaccgcgacgccacggatgaccaagtgaccatcgacgcggcagaagcgatcaagcgcgaacatgtgggtgtcaaatgcgccacgataacccccgacgaggcgcgtgtggaggagttcggcctcaagaaaatgtggaagtcgccgaacggcaccattcgcaacattctcggtggtacgatcttccgcgagccgattgtcatagacaacattcctcgtctggtgcctggttggacaaagccgattgtggtggctcgtcacgcgttcggcgaccagtacaaggccaccgacttcaaggtgccgacttctggcactctcaccgtgactttcaccccgaatgacggctccgggccgatcgaacatgtggtgttcgattatcctgggagcggcgtggcgcaggtgcagtacaatctcgatgaatcgattcgcggcttcgcacgcgcatgcttcaactatggactcctgcggcactaccccgtgtacctctccacgaagaacacgattctcaaggcctacgacggcgagttcaaagacattttcgccgaggtgttcgaaacagaatacaagcaacgttatgagcaggagggactcacctacgagcaccggttgatcgacgatatggtggccagctcgctcaagtggcatggcggttacgtgtgggcctgcaagaactatgacggtgatgtgcagtccgacactgtggcacagggattcgggtcgctgggactcatgacgtcggttctcatgactcccgatggccaaaccgtcgaagccgaggccgcccatggaacggtcacacgccattaccgtctctggcagaaaggcgagaagacctccacgaacccgatcgcctcgatctatgcctggaccggtggcctcaagcaccgcgcaaaactcgatggcaccccacaggtcgccaatttcgcggaaacactggaacagaccatcatctcgaccgttgagggcggccagatgaccaaggatctggccatactcatcgatccaagccatgaatggctcgacacagagcagttcatgaacgccctggatgagaacctgcaaaggaaccttgccgagcagcgttgaatctgacatcctcacgacattcggggcctgtgcgtatgcacaggccccgaagtgttgcaggtcgggtacaatgtaacggcatacgctgcgatctaggcaaagggcaagggcggttatgggcaaaggcacctctcacatcattcgcgcattcgtctcgttggcgatggctggctcactgatgtgtgcaacggccggatgctccaccgatccattgaccggtaccgccaccaccagcccctcggccaccaccgcagcttcgacagggcacgtggcgctcttccttccatcgaactcccctaatctttcgcagaacgttcccctgaacaactggaacaccctcaatgattcgctcgagaacgcgctgtccactggcggattctccggcaagtccatgaaccgtgagaccagcggttcgttggcaagccagagcgatgccttgaagcggtatgtgcaggaacggctcaatgcggattccaaggagcaatacggcgacccgcaaaccgagcagggggcaacgacgattgtcatcgccccggccgtcaggcttgacaggaactacggcgaatacagccatttcatcaccactccgaaccaggagccctccgaccaggatgcatctgacactgactcagatgaatcctcttccatgcgccagatagccgattcgctgaacaaggcgaagaacgcggggatgcatgtggtggtgctgggcaacccgatcgacggcttcgttccgaacgtctacgtcccattggtgactgccgctgatatcggccgtatgcaggcacagcagatcgtatccaaactcgatctcgatgcggtgagcgagtcgaatcccaaagccatagaggtgctcctgccgaacaccgacccgtccggcaaaaacaattcgttccaagcgcaggcgtttgaaggcatctgggaggttctggggccgtatttccggcagcgcaaggcatatagcccctcacaacgcctctcgttcttcaccacgaaaagcgattacaaggatgtgatgttcaaggcgacgaaggactcccagatagaggatgagctcaagtcacgcctcgagacgaaaggacgcgatgctgccgtacgcatcgacggtatcctggcgatgaacgatttcaccgcggccgcatcgatcaaggcactgaaaacgatgggctattcaggatcctccatggatgtcaacccctccatcaccattttcgatgtggtgggcaacattgcaggaaggaagccactgaacagacaacgtgtgcctgatccggcacagtcaggtgatgagtccgcgcaaccatcccagacaacgaagacggactccaagcaatggcccattatcaccggttttggtgcctatatatccgatatcccgaacattgtgaatggattgcagtggatgaccggtctggtggacgtccatgccaacaccggcaccattgcacaaatcgcactgcagctcaaccgcaaggagaagctctccaacattgccgagctcaaaaccagcgacgactacggttcggagatccccacactgcatatgaccctgctggccgtgagtgccgcaaatctgaaggccgcattgatcgatccgggatacatctcattggccgacgccgacatgtgatgtgatgtgccggtgggacgctattcggaatagggaaccagccgaatctgcattggacgcaggaatgacgccggatcgagatagtccctgcgcccagtgcgcttgacaccccaatgcacgcaactttccccacagtggtcgctctggcctccgaccgaggcgaatcgctttccgcgatgcactttgtcgcccaccgccagttgagtgtgcgccggttcgaatgtgagcgtgtacggacctgtgtcgatactcaccaccgatttccccgccaccatcccgctgaaactgatggccccatcgctgggtgccagcaactcatgcataccattcaacgagatatccactcccctatggccagggctccattgccattccggccggtcgaaccccctgacaatcaatccatcgggcacgggcgacagcatgcgagcatggcacatttcccctgcgattgccgtacaaccagcaacgagctccatgccatgaatctcactcgacgagacagcgagcggggcaacggcaccgcaaaccaggcatagcgccagaatcagcagttcatgctgcatccgcagcaaccgcagcatccacaatctcaccatcctgagtctgcgagcccgccatcgacgccacccatcccaggaagtcccatgatgtgccatatctcctccagccacgtagtgatctggattccactatgactggttagcatccacgtgtccagtctggcaggtcattgtggtcggagaacgggttatgccatcaccccattgccgtcaatggcatgcactcattgccgagaaggatgggaaaggtcgatggcgaatccgaagacgtcattccagcgaatcgagcacctcgtcaataagcagtcgggtgcgaacagctcccggtcgaagacgaggaaatctgcgcatggcattcgttggatccgaatcggcggcacgtgccacgttcgatttgctggtgccatgttgcacggctttctcggccaatctgtccaccaatgaatccgacacctgccgcagccgttcagccacccagagttgcgagacgtcggaagagagtccataatcctcttccaattccgacgaagcctcctgaacagccgcccacagcaccatgaagggcttacggtaataagcgatctggtcttccatgcgttcgctctcgatcgctgcaagagcacgccggtcatcagtgttcctgctcatacgcgcacacccacctcctgtataacaaaaaagccgcccgagggcggctgatggctcctgcgactgggcttgaaccagtgaccgtccgattaacagtcggatgctctgccaactgagctacgcaggaatgcgctcgcatgatctctcacacgcaacagacatataatttacacacgatactttgaatacgcaaatccggcgtgtcggcatactccccggattcatatggcacgaccgtcattttctccgatgcgcgtagaatgcaacatagagagaaatccgcacaatatgcgacggtcttatgccccgcaaacccaatcagggagaatatggagccagtgcagccgaatatgccgaaatccagcgacgaccatggtgacaccagcagcacggcatcatccacacatcggaatgcatcgatcatcgtcatgctctgtcttgccattgtcttcgcagccggcgccgcactcatcgtgcacaacatgaacgtctcccatctcacccatgccagacatatgtgcgccgcggcaagcgataaactgcgcatcgcgatgaacacctacacatacctgcacgatagcgaggcaagcaaggcataccatcttggcacctatgacgtgcaggaccccaatgtgctcgtgcaattcgccaaggaatatgaggagaaggccccggaaatcaccgggtgcaatgccgacagcgtcgaggaactgcagcgccgaaccggccgcatcatggagaacacaggctggtacaccactcatcacgacagactcaaggagctgaccgaattggtcaatgagtcgcgtcgcgacaccgtatctggcacacaatgaaaaagccgcccgagggcggctgatggctcctgcgactgggcttgaaccagtgaccgtccgattaacagtcggatgctctgccaactgagctacgcaggaatgcgctcgcatgatctctcacacgcaacagatgtttagtttagcgggtgagtcgaaaaatgcaaatcaacgcgtgtcgcaccgtatccccggcgggatgccgcaccaatccggagataaccactgcaatacctcacatgcagatcttggtaagcggcatcgcagagtcaatggggaattccatgtcagacggcgccacaccggcctccaccaaattcgaaccaagcatcgccaccatggcaccgttgtccgtacacagtttgatctgcggtatgcgcacgtcgaccccgtgattgcacccaacctccatcagcgcctcccggagctgcgagttcgccgagaacccaccgcccacaatcaacgtggtggaatcgaactgctcgcatcctcgcatgctctttcgggaaagcacctgtgccactgatccagccagcgacgcacatacatcgtccaccggaatctcctgcccgctcccctgccgttcctcgatccaacgggcaatggctgttttcaccccggagaagctgaaatcgtacggatgctccttgcccgcgcgaccttgcgtgagtccttgcggcaccttgatggcatgcggatcgccatgctgggcatgccggtcgatgtatgggccgccgggatatgggaatcccagcagtcgggccactttgtcgaaacattctcctgccgcgtcatccaatgtcgtccccaccacctcgacatcacgcgcgatgtcgttgacatgcagtagcgaggtgtgtccgccagagacgatgagcgccatcgtattggccggcaggtcgccgaactgtagttgcgtgacggccacatgcccgatgacgtggttgatgccgtagatcggcttgttggctgaccaggccaatgccttcgcccccgaaacgccgaccgcaaggcaccctgccaaaccgggacccgccgagacggcgatggcatcgacgtcgtcgatggtcatgttcgcgtcggcgagcgctttcgataccaccggtacgaatgactgtgcgtgcgctcgggaggcgatctcggggatgacgccgccgtatctggcgtgttcgtccatggatgaggcgacgacattcgccagcagtgtcttgccttgcacgacggcggcggcggtttcatcgcaggtggattcgatgccgagaatgatttggttgctcattgttttctttcctgggcttgttggcgtggcgctgttgggatcagcattgtgtgttcaatggtatggcgaagcctgcgggtcgggaatcgcgcagggtgaggctcatggtgtaggcgtctttgttttccggctggtagtagcgtttgcggattcccatggtttcgaatccgaagtggcggtacagggtgagtgccggttcgttgtcgacgcgcacttcgagcagcatgcgttcggcgtggagttcgttggccttggcgatgagctggttgatcagttgggtggctatgccttgtcgttggcgttcggggctgacgcctatggtcatgatctgtgcgtcatatccgtcgtaccagaggccggcgtatgcgtctatggttccttggtcgtccacgttcacatagtagctgcggtgtggcgcgctgagctcttcatctatgagtgtgttgctccacgcccctttgccgaacagttgtagttccatcttggctatttgcgagcataccgtggcgcggtcgagcgtgttggcgtcgacgatcatgcgtttgcctcgttgcgatgtgctccttcgtggttgagcacatgtttgagcgggttgggcacgctgacgtcgggtctgcgcaggtagaggggctcgatggggcgtggattggcgtcggcttcggtatcgtgttctgcgagtgctgcgaaggttttcaccccccatgcgccggtgtcgaggagtgaatggtcgagggtgattccgtgccagggttgttcgctccagatttgctcgtatttgcttgcaccgtgtccgacgatgtcgacggcgaccggctggtcgggatggcgttgctgtatggtggcgaccgctgcgcttactttggccgcgatgttcgatggcgtgcctatgttcatgtcgagttggatgcgttcgtctttggtgtctgcgttggtgtttgcgagcagggtgtagtagagctgtttgcggcgcgcgtcgttgacgctgagggtcaggtgcaacgcggtgcccgcattggctggtgtattccagttgccgaatatggctgtgttcagcaggttcggatcgccgttgtaggccgcttgcatcatggcggcctgtccgcttagggaatcctgtccgaggagttgtgccccggtggcataggcgattgccttggctgccacgatgcctgcgcgtagtccggtgaagggtgccgggcctattcctacgactatgcgttcgatgtcgtggggttgtattttcgcctctgcgcagacttgcgcaatgtcgtgctgcagtttttccacgtgtgtgcgcgaatcctgttcgcagattggttcatgcccggttatgcctactgtggatccgaatgatgtgtcgatgactaacgtgttcatgtgtctcgtgtcgcttgtttcgtgtgttgtgttagagtgcggttcttgtatcgtatgcgttgcccgtcggcgtcgtcaggcttgggtgtcggctggttccgccagggcgaatcgtgttcccactggggtgatggtgacgatgcgttcaccatctgcggtgggttcgttccggcctatgggggcagacacatggtcggtgggtctttggatgcggatctccaagcgttcgtcggcgagcgcaactgccatttgttcgccccattccatgaggatgatggtgcgtgtgcccggttcttcgagttcctcgtcgaggccgagggattcgagttcgtcgaggagcaggtcggcctgtgcctgacctggggcgtagtcattggatccaagccggtaggcatccacgtggatcagatgtgcgggagtgccgtccgcgagggtgccgtcgagttccctggcgatggtgaaggtcggtgagacgatgggttcttgaatgcccaggccttcccccaatccttgcgccaatgtggtcttgcctgcgccgagtggccctgaaagcaggatcacctcaccaccgtgcaggctgcgggcgagtcgctcgcccagctcgtgcatggcctgtgcggtcggcacttgcaaggtaatcgtgctgtcaggttgtcgtggtgcgggtgacgggttgggctcgagcatatggtggatggtgttcattggattcctttggctccgatgagttctatggtgttctcaagtgcgtatatggggtcgcctccgcggctcttgcattgttcgtccgcccaggcgagtcgttgcatgcaggcgctgatgccctgcgatgtccaccctcccagacgtccgttggccgttcgcagcgcccattcgttcaccgccgccttggttttcgagatgtccccttgacgaatggccgcggctttggcgaggttgcgcatttgcaacgcgagcgcgccgatgagtgcaatcggttccgttccttgggcgagcgcggatctcagggcgatcactgcacgtgcggttttcccgcccatggcgaggtcggccacgttgaagccggtgaccttggggttccctgtgaggtattggttcacacggttcactcgcatcgggtcgtcatcgaagtcgaagcatagctgcctgatcatggcggccagctctcccacatggtcgccgagcacattgaccagttgctgtgcggcctgcgggtctatgcgcctgccacgcgattggaactgctggtacacatagttgagtttgtccttggccttgtcgagtttgggaaccgtgtcgacgggaatgttgttgcggcgcatgagcgcttccacggaacggccttttagcgttgcggcgcattgcatcaccaccggcgacgcttctgggtcccggtttgtttcgttggcgtaggccacgatggcgtcgagcagtccggagtcggcgtcctccgcatgttcgacccacaccaccgacctctgcgagagcagggagggactcaccgcctcgtcgaaggagttggcgtcggcgctgcgggcgtcgacgcgtgccaattcggcatccctatgttcctcaagcaggcgatacacggcatcccgggcgttctgttcgttcaggtactcatcgccaccgtagatgagcaggcatagtgttgctgcggtcatatcttcaatgtcgacgtatgtttggacaagtcttgcgacaccggcttttgcctgcatccttcgtctcatctgcgccatgtcagccaccccatcatttcgagcgtatgttcgaaccattgggtgaggcgttccctgaccggcatgcgcatgggacggccatcaccgttggtgaccgtgtcgtcataggctcgcagcaggtccccgatgcatacgatcagcgcccatgtggtcagttccgtcacgatgagcaccgcagcgccgggtataccctccatccatgccaaggtgctcgactcctccgagccgaacagacgtgccgcatattcgatgaccgtcgtgcattgtgagcacgcccatgccaggaatcgtgagacgcccggcgccatccatgcgacgaacaacgagcacagccccagaatcgtcgcggcatcgacgaatggtgcaaccagcagattcgctggcagcgaccatattgacacctcgttgtccatgagaatctgtacgggaccagcgaatagctgtgcacagcatgaagccgccaacagcttggccaaacggtccggtagcagatgcgacacccatgccgtcatacgcgtgcatgccgtcgacaagccgaacaccgccgcacatgacaacgcgaagccgtaactcgaagccaatgacggatcgagcagcaatccgaacaccaccgtcaggcagagcagatgcacactttgccgacgacggcccaacatcaggaacccaagagacagcatcgacatcagcatcgcccgtgtgaccgacctgctgggggcaagcaccatcgtgagcatcgggtagaccattgcgagcgcgcctgccttcacaaaacggttccaatggagccgtgcccccaatcccatcaccaatgtgccgacgagggcgtaatggcctccggatacggccatgagatgcatgatgcctgcacggcgacactgctcttgcaggagttcggcgtattcgtcctccactccaccatctgcgcagtgcaccatcgcatcgtgtccgagcacccccagggtcacgccgggaaccaacacaacgcccggattgtcgagtccgcgggtcgtttgcaggaatgccatgcgtatccgatgtaccgcacgccatggcgccggtggctccttgacggccatcatgtcaccgtctgcaagcacccatatgggcatctcaccatatgccgccgcctggatggttccgacgatggcgtagtccccctgctgcgcgatgcgcccacaggccggctgtcgggcgaacacccgcacaccgcgggacgatggacgtcgaacgtcatggcgaacgatggaccgggcattgccgtcgacctggcagtcgtatccccccatcgacgtcgccaacggcagtgaatgcgccgtgaacgtcagattcacacgctccgtggaggaagatgccgacatgttcaccgggtcggcatgctccgtcaggcttcgcgccgccgtggcaagtgtggccgcgagtatggcgaaacagaccgttagcagtgtgtacagcatccggtgggcgcgatccacggccaatccatggtgtttccccgccccgttcatcgtgaggggaatgagcaccagtgcgatgaagatggctgccgatgccaccgccaggcacgccatttgcagcatgcggccatgctgccagaagacgtcgtgccccgatccgtgttgggagcatacccatcgggtcagcagtgtggcgctccaaacgcccgcagccaccggcagcatgcgcaggtctcggctgcctgcgattcccctgtgctcccggtcgcatgccggtgccgtcattgcgcgcatgcccatggtctcagcttctctacggtcttcatgccgatgcccggcacattcaccaagtcgtcgagactggcgaaggcgccatgctgggtgcggtattcgatgatcctcgcggccgtcaccggtccgattcccttgatctcctgcagttgtgcctcgtctgccgtgttgatgttcaccaaggtgtcctgcttgttgtcggatgccgatggcgacggctccggtgcagccgtggaaggcgtcgaatcccggtcggatggcgatgccgtggccgtcgtatgagatgacgcgtttgtggtggcctgcgtgtccaaggcgcccatgttggcggcctgctgcaccaggagggtcagggtggtggccagcgcacagaccaacaccatgatgcacagcagcgcatgcttcggttcgagttcgaatcggggtcgttccagacggcggactccacgttccgcttcgaaatcgtcgtcgttcaccacggtcaggctcgacagcagtgcgcccgccttctggtcatctccagaaacttccctcacaccacccgatgattgctcgttgcttgccgtgaccgatggctcctggacaccgggaggcggtggcaggggcaccgacggcatctgaatgctgaagcctggaccggtggatgaaccggctgccatgctgcgagacgatggccctcccagatggcgcagccgcgtcacagccccctccctcagcacgatgacggcgtccgggctttcacgccgtccggaatagacaatgcccatgccgccacttaatcatgacggcatgggcattgcaacgaggacggccacctgtggtcggaggacgtgatatccaccacgcaggtcatccacaggtgcacgacctgcgtgcgatcattcgcccgggacgatcgaaacaatcttcggggccttgacgatcaccttgcgcggcggcttgcctccaagacgctcagccacagcctccaaggccatcttctccagttcatccgggtcgatgtcggcactcacctcgagtttggcccgcaccttgcctttgatctgcaccacggcggtgacggtgtcctgcccaacataacgctcgtcggcctgtggccatggatggtgggccaacgactcatcatggccgagccggttccacagctcctcggctatatgcggtgcgatcggagccaccatgagcaccagcggctccacggcggcgcggggcacgccgttcatgccggtcaggtgattgttgagcacgatgagtttggcgatggcggtgtttggacgcatggcctccatctcaccggtcacctcggcgatcgtattgttgagcagtttcaacgtacgttcgtccatcgcgtcgtcggtcaccgtgacctcgccggtgttctcatcaatcacattgcgccacaaacgctgcaggaatcgcatgccgcccaccacattgcgggtgttccatggacgtgactcgtcaagcggtcccatgctcatctcatagaggcggaatgtgtctgcgccgtaatggtcgtacatgtagtccggggtcacgatgttcttgaggctcttgcccatcttgccgaactcacggttgaccggttcgccttcgtaggtgtacacggtcttgccgtccacttcgctctcctgaacgtcctcggccggcacatactgaccgcggtcatcggtgtaggcatacgcttggatcatgccttggttgaaaagcttgtggaacggttcgaacgaatccacgtaccccaggtcgaacaggatcttatgccagaaccgtgagtagagcagatgtagcaccgcgtgctccacgccgcccacatacagatcgacgcctccggcctgcccggccgccggggagtgcttcggacccatccaatagtcgtattcgtcgcgctccaccatgtgctcggtgtcatggggattgaggtaacgcatgtagtaccagcaggaaccagcccaattcggcatcgtgttcgtgtcatgatggtaggtcttcggaccgtcaccgagatcgagcgtgacattcacccaatcctcgttgcggctcaacggggcctccggactcgactgggaatcctccgggtcgaaggtcttggggctgtaatccggaacgtcgggcagattgatgggcagcatgctgtcgggcaccagatggggcacctcatgctcatcgtagacaatcgggaacggctcaccccaataccgttggcggctgaagagccagtcgcgcagacggtagctcgtggcccccttgcccacctgggcctcctcgagccacgtggtgacggcagcaatcgcatcatccacacgcatgccgtcaaggcagagcgcgtcgccacgggcccacgtcgcgtcgacggctgaattgatgacgatgccgtcatgcgaaacgaacggggcggtaccctcataattggccagatcgtcaccggaatcagggagcggcgcaaccgtgtagatcaccggaagaccgtacttgacggcgaaatcgtagtctcgctggtcaccgcccggaacggccatgatggcaccggtaccatagtccatgagcacatagtcggccgtgaacaccggcagcttggcaccggtgatcgggttgatcgcgtacaggccggtgaacaaacccgtcttctcaccgttgtcggccacacggtcggccgcggtctttgcctccgcgagctcacggtatgcggatacggcctcgctcggcgtggcatagccacccgtccacgccgggtccacaccttccggccaggattggggcacatgctccagcatcgggtgttcgggagagaccacacagaacgtggcaccgaacaacgtgtcgggtcgtgtggtgtagatctccatatctgccatctcaccgtcgaccggcaccttgaaatgcacggaggcgccatgcgactccccgatccagttgcgctgcatgagcttgaccttctcaggccagtcgatggaatcgagatcctctatgagacgatgcccgtatgcggtgatgcgcatcgaccactgacgaagctcacgctggaacaccgggaaattgccacgttcggaacgcccctctgcagtgacctcctcattggcgagcaccgtgccaagcccagggcaccaattgacaggcgatttggagatgtaggcgagtcggtactcattgagcacctcggtctgctccatctcggtgagttcatcccaggccttgtcctcatgtccgtcaatcggacgtgtgccggcgcggaattgtccgatcagggtggaaatcgggcgcgcgcaccccatggatccactcggatttctcgtatccggatcgtaccaggcatcgtagatgcgtgagaagatccattgggtccaacgcacgtattccggttcgatcgtggcgaaggagcggcggtcgtcgaagctcagccccatgcggcgcaactgtcgccgcatattcgcgatgttctgttcggtcgtgatgcgcgggtgctggcccgtctgcacggcatactgttcggcgggaagcccgaatgcgtcatagcccatggcgtgcaggacgttctcgcccttcatgcgatggtatcggctcaccacatcggtggccagatatcccaacggatgaccgacatgtaatcctttgcccgaagggtaggggaacatgtccatggcgaagaaggactgacggccatcggcatgacgtcccttgctgtcagtgagttcgccgctcacgttcgcggcccagaacgtgccctcgctctcccagatgtcctgccatttctcctcaatgcgctgggccatttccgtcgtatagcggtattgtggcgtagccggcgcattcgatgttgcttgcgcgttcgtatcgttctcactcataggcaacgattatcgtgacgcaactggacagtgggggcgtcatgtccaccagtcgacccggttgcaccgggaggggatgcgcccgttattcgtcgtcctgcgagcgtgcaaccgtcaccggattgagactcagatccacatgcatacccaactcggtttccattgcgtcgatctgggcgtcccatgcgccgtcatcgaccatctgctgcagggcggtgtcgatgagctccatgagcttgcgctggtccgccttcactgcgatgccgaaagcctgggtgccgtagctgtcctcctgcagatgcaggtatcgggtgccaccgtccttgcgcagtcccgccagaatcggctgtggcccggctatggcatcgctctggcccaccagcaatgatgccgagcattcgctgtagtcggcacgttgcaggatcttgatccgtgggtgacggtcatggagttgttccccggaatactcgccggcgaccgtgcacacggtcctgccatcgagtgactgcacatccggcagccgacgtgcgtcatcggcacgaaccagcagttggttgcgagcgaccagatatgggcccgagacctcgtaccgggtgccatccgccgtttgcgtatggtccatctccaacgcattcttgccaccgtcataggcgaacgtgaccatagcgaaatcgacgctaccatcgtcaagcctgtccaagcgcgtggcgggggtctgggagtggaagaagagctgctcgtccccatagccgagcacctttgccacatatttggccacttcgacactcagaccgctgtattcgccgtcatggtaccaaccaacccccggttcatcggccggcacgccgatcgacatgaccggccccttcgcctgccccggggcgctgacattcaccgaggtgccgcagccgcaaagccccactgcgagagagattgtgaggatcgcacgggagatggttctcagtcttgcatgcatggcgcgcctcacttgaacagtcgcgagcgtgtgaggaaccagatcaccgctcctgccaagacgcaggcaagcaggacgatgacgaggaacccccattttgaatcgctcaacggcatgccgatcatcccctgttggaagttcatgccatacatggagaaaatgagagtcggaatcgatagcgtgatcgagatcatcgtgaagatgcgcatcacgttattcagattgttcgacacgatcgaggcgaacgcgtccgtcatgttcgcgagaacgccgctgtagatgttcgccatctcgatggcctgcttgttctcggtgatcacatcttcaagcagatcctcgtcttccgggtactgcttaatgcgtgtgagcgtcatgagcttctccatgacgatctcgttcgatttgagcgacgtgttgaaatacaccaaggtcttgctcagttcgagcagcatgagaatctcgcggttctgcatggagtggcgtagacgcagttcgagtttatcggtctcccggtcgatgatgcgcaggtaccgcaggtacatcgtcgcgtttcgatagaggatctgcagaatgaatctggatcgcatgaaagtgttgaatccccggatcgtgccttccatgaacggatggagcaccggggtgtcctgcatgcacacggtgatgatcatcgtcttcgtcacgatgatcgacaatggtatcgtctcgtaccaatccctgccgctgcgttcctccacggtgggaatgtccacgatgatcatcgtgtagtcatcctccacgtccacgcgcgaacgttcctcgtcatcgagcggggcacgcagatcggcgaggtcgatgcccgtctcctgcgagacggtggcgagctcgacatcggtgggatcggccaacgccagccaagagccgttctctggtttcgaaatctgccgtacctggccgtcaacggtactgaacatacgcaacatggggcatcacccgccttcatcgtgtccggcattcgccactggacccgcgacgccacacgtaaggggtgcatgcgtcacggtcgctttcaagccaacgcaccagcatagtcgcagggttgagacagccgggcagcatcggcctaaatcagcggtttccacatcggcatgtctggattgcgcaggtacgccgggccgttctcccagtcaacggcgtccgccacatccggccccttgtcatattccgtaagatggaacagcacggaattcgaagtgtactggggttccatacgactccagaacgcattgcgcataccggtcagattgtcaagctgcgaatctggcagacccatgaggtttccaatggttgcggcgatccatgaaccgtgggagacgacgaacaacgtggtgggctcatccatgtactgggggtcgtcgcaataggaacggatcgtggaactgccacgtttgccaaggtcgggacggctttccaccccataggccgcctcgccgccctcatgggccttccacgacgcatatccttccgggtaccgctcattaatctcctctcggctcatcccttcccattggccgaaatcacgttcgcgcagacgcgaatcgagtgtcacgtccaatcccagcgggtcggcgaaagcatgggccgtctgttgggcccggaagagatccgagctcacgaccaccatgcggcgtcgcgacgcaggggcttgctcatattccgtgatgtcgctgcgacgaatcgggggatcggagggctgggaaagcctgtccggatgccgggcgatattcgacaccttggcccaatagaaccgttgggcgagtgtgaatccgctcatatccacctgccactgccccacgatatcgagtggaatgtcgatctgcccctgcaagcgccgttgcaaattgaatgcggtgcgcccgtggcgcatgaacatcacttcatcgatcatttcttcccgtcctttctgttcccatcacccggcatcgatccgcatggaacaaaaatgccgaagccagacgacaggcttcggcattttcggtatatggctcagtcgtgcgagatcaccgtgccggcctttgcacctgcggagaggtcctcgatctcgctgatctccagcaccgggacgcaggcgggaaccttggtgccacgttcgttggcgagcttgacctgttcgtcgtaaatggcgtcgtcagtgtgcagcaccacttcaccacggaagcggtagcccttcttctgttcgaagttcgcgaacgccacgaccaacgggctgccgttctcgaggttgcggtaggtctgtccggcagtgcgctcatgataggcaagatggttgtcgtcgagcacgaacatcgacatcttcggaccgaggtcggggatgccgtcctggttcacggttgccacccatgccagattgttcttgatgaattccttcatatcttcagtcagttgcgccatgatgttcctttcgtcatgtatgactatcacactacgcgatgacatggcggcatattcgggtttgcgctgtggaaggatatggggaatgtgatacttcagaagacgaaaacaaaaacccggcatagccgggttggtggtggagctaaggagattcgaactcctgaccctctccatgccatggagatgcgctaccagctgcgccatagccccaaacaggtgtataccacatacctgccatcgcagattgcctgcgattcgtggagctaaggagattcgaactcctgaccctctccatgccatggagatgcgctaccagctgcgccatagccccgtcgttcttcgaacgaacctgtgctagattacaacattctgtttcgatgagcaaatcggcgtgtcgcattgacgcgttcgggcggagcatatatggggatggccgggaatcgattcccggccatccccatatatgcctactattgctgagcttgcgaaccgtctttcttctgggtggtgcctgaattggttccgtcattgacggaacctcccgaatcaccattgccggaatccgtgttctgcgtatcacccgaattgccgtcctgaccagcggaaccggtgcccgcagtcccagacccattcgagttctgggacccggacgaccctgaggatccggggttcgatgagtcagagcctgagttccccgaaccagtattcgcattgcccgaagaggatcccgaggattgtccattcctgtccgatgtcgaagaatccttcgtatgacgcgaatcggtatcacttccctctccgctctgcgtgggcgccggtgtctgtgtgggcgtctgggtgggcatctcggccggcgtctgcgagtaagtggggctgaccacgtcacgcaccacggagtcggtgcccttgcctcccgtcaaggcgaggatgacacctgcggtgatgcccaccgccaccagaccggaaatcagtgcgacaatcacggccacacgtttgtcatgcttggtcatctgcggcttcgtaccagcctgcgggtgcttcgaagcatcggtggcatgggttccggagaccacggtgcgtgcgccacgggagctatcggaatgtacaggtgcgatggtctgtgtgtcgtcgatatcggccgtggagtggtcgcctgtatgtgcattggcatgcggcggagcaaccccaacctgttgtgcggcatcctggagtttcttgctcgacgcgtcaatcacgttctgatagagctgggaagccgcagtggagacgatggaggccacggccacgccgattaccgaacctgcgatgccgatcttcgacgacagcagaaacgatgtcaccgcggccaaggcgcctgccagcagctgcgagaacgatattcctttgaagaagtttttcacggtgctttcaatgttcagatatggttggaggcgcgttcgtcatccgcgcctcatagttttcgtcttcacagcatacacgccaagacttgaggtgtcctgtcatttcgctggcaaagtgtctgggcgctcccaatactgtgtatcggccagggcgggtccatggttgtagtcctccatgatccaccggctgtccatgtcgatatcggcccttctcagtctggcccagtgcgcgttgcacatcgaggtgagcgtgaaatccgggtatcgtcgttcgatgccgaacagcacctgcagcgcgttttcgatgagcgcgccatgggagaatacgaacaagtcggtgtcgtcatcgcattcatgggcccaatcattcatggcctccatgctgcggacaccggcatgttcgtgggattcggcgccatgattcatctcgccgcccatgccccggcaccacgagtcgaagtcctgcgggaaattggcctgcaggtatgcgccggatcggccttcgaattcaccgaaatgccgctcgcgcaaccgttcgtcggcatgcacttcggaccccagtctatcggcgaaggcatgtgccgtctgcatcgaacgttcgaggtcggaggacacaacgagctggtgccgagatgggtctgggagcacatatagcttaatcagtgactgcgcggactggttcacctgccacagcccgacctcatcgagcggaatgtcgatcgatccctgcaccagcccttgtgtctgttgtatgaggtgcggccatggcgtgcgtacggttccattcgtccgccgtcactcttcggtatcggcgtcgctggacttgatgccccggctttccggatgctccagttcgaggtcaaccggttcacaatcacgccacaggcgttcgagattgtagaagtcacgtgcctcgtcatgcatgatgtgaatgatgaaatcaccgtagtcgagcagcacccactgcgcctcctcgacgccctccctggaccgcggcttacggcctccatccttgaggaacagctgcttctcaacctcctcggcaatggccagaacctgacgttcgttcgaagcggaggcgatcatcatgaggtcgcagatgccgagtttgtcgcccacgttgtaggccaccacgtcctccgccttcatgccatcggccgcagtcgcggcgacgcgcaccgaattgatggattgttccaaagcattcatttcaacgctcccaagctggtttccagttgtctacaacatgttgcgtgttctcggagtacaccatcgcgtcgcccgggacatcatgtcggatgaccgatcccgcaccgctggtgacaccgtcccccacattgaccggcgcgacgaacagattgccggcgccgatatgcacgtcggaaccaatatgggtgtggttcttgtgcacaccatcgtagttagcggtgatggtgccgcctccgatgttcgtgttctcgccgagatcggcatcgcccacatagctcagatggggcaccttactgccatcgccgatgtgcgccttcttcatctcgacgaatgcacccgcctttgaaccagtgccgatctcgtttcccggacgcaggtacgtccatggtccaatgttcgcttcccggcctatgcggctctcctgcacgcgggaacgctccacatgggcctccggctcgaccgtcgcatcgatgagcgtggtgtaggggccgaccacagcgtcatgggcgattgtggtgtgtccctgcaggaagcaccccggcagaatcacagcatctgactccatctcgacctcgtcttctatccaagtggtctgcggatcgacgatggtgaccccgtcgagcatccactgcctgcatacacgcagattgtgcgccttggccagcgacgcgagctgcacacgatcgttgacgccctcgacgctcaaggggtcgggcgcggcgaaggcgccgactttgctcacctgccgcgcgacagtgagcgcatccgtcagatagaactcgccttgagcgttgtcggcattcagattggcgatggcctgttcgagcaccgcggcatcgaacacgtacaccgatgtgttcacctcacggaccgcgagttcggaactgttgccatccttctgctccacgatcttgagcacgttgccgtcggcatcgcgaatgatgcgaccatatccagtcgggtcgtcaagcacggtggtgagcacggtggctccgtcaccactgtcacgatggtaatccagcaattgcttgagtgtggaggtgtcgagcagcggcatgtcagacgcggtgatgagcacagtgccagaaagaggcccctgctccccgagctgctccatcgcgcattgcacagcacgtcccgtacccgggatctcatcctgttccacaatgagcacagcgtcatcataggagcgggccgcttcggccactcgctgtgcctgataacgcacgacaacggcgagcgtctcgggatcgagcgccccgaccgcatccatgaccctgttgaggaaggtctttcctgcgaattcgtgcagcactttcggtttgcgggaacgcatgcgcgtcccctcccctgctgcgaggacgattgccgcggtcaacgtcatggaatgcctccaaacctataaacgacgaacgcctaatccgcgtatgcggaccaggcgtccaattgctcccccacctggactcgaaccaagacaaagggttccaaagacccgtgtgctgccattacaccatgggggaacggcggagtgactccgccaagtgttcattatgccatatgcccagacttttcgccgccggtgtgtttcacatctgcacagcgaccaatcaggcgaacaggaatccctgcccgtgatgttcagggtaggtgtcgaacaattcggccactgagccgtcctcgaatacggctttgatggcggaggaaagcaacggcgcgatggaaagcaccgtgagaccgtcccaccgcttctcctcgggaatcggaacggtatcggtcagcaccacctcacgagcgccgcatgacttgagacgatcaactgccggtccggaaagcacgccatgggtggccaccacggtcaccgacctggctccggcttcacgaagcacctgacatgccccggcgatggttcccgcggtgtcgatcaaatcgtcgaccagaacgcaatccttgcccttgacatcgcccacgacacggttcgccttggcctggttcggccgcgtgatgtcacgggtcttgtgcacgaaggccagcggaccgccgcccaggcgttgcgcccactgctcagcgacacggatgcgcccggcatctggcgagacgacggtgacattgtcgagatgaccatcgaaacgatcgcgaatatagtcgaccaataccggcatggcaatcagatgatccacaggtccgtcaaagaagccctgggtctgggccgcgtgcagatcgacgctcatcacgcgatcggcgccggcagtacgcagcaaatcgaagacgagacggcaggagatgggttcgcggccacgatgcttcttgtcttgacgggaatagccgagcaatgggcatacagcggtgatcgacctggctgaagcgcgcttcagtgcatcgatcatgatgagctgttccatgatgcttttgttcaccggagtgcaatgactctggagcacaaacacgtcggctccgcgaacggattcggtgtagcgcacatacatctcgccattggcgaagtcgtaggcggtggtctcgagaacatcgatgccgagctggtccgcaacgtcggtggccagcttgggatgcgccctgcctgttacgagaatgagatttttatcgggtttcccctcgagaattgcactcaccgtgtctccaaacgtcggtcgtcggttacgcgtccaatcataaatcgctgtttcgactgagcggcgcgataccagagccggtgacgtgccgctacttcgcgtcctcgtcgtagatgccgtgcttggctatgtattgcaccacgccatccggcaccaggtaccacacgggttccccgttgcgcgcacgttgacgaacatcggtggaggaaatggccagtgcgggaatctccaacatgtctaccttgccagccggcagcgggaccttcgaagagtaaccggggcgcgtcaccgccacgaaatgggcgatgtcgaacatgcgctcggcgtctttccaccgcatgatctcagcgacggcgtcggcaccggtgatgaagaacagctcggcatcggggtagcgggcgcggatgtctcgcagcgtatcgatggtgtaggtgacgccggggcggtctatgtcgacacgcgagacgacgaacttcggattcgaggcggttgcgatgaccgtcatcaggtaccggtcctcctcattcgtcacatgcttgtcaagcttgaagaccggacgcccggtgggtacgaaaatcacctcgtcaaggtcgtagacccacgccacttcggaggccgccaccagatgcccgttgtgaatcggatcgaaggtgccgcccatgatgccgatacgcgcatgggcgtgccagttgccccgagccgaacgtcgcccgtgctgcgagacgagctccacctcgcgttgtgcatagggcgacagctcggacatgctccgatccatgggcgtggtgccgttcattcgctggcccgatccgtgccgcgaccagcttcatcggcatcaagggcggctttttgcacatccttggccagaccgctctccccgttgtcgttcatcacggtgtcggaatcgatcttgcccatgtcctcatcccattcatcctgcaccacacgacggatttccgcgaatgtgggcagcaggaacttgggctggtagatgctgcgtacacgtgccactcgttcggtgatgcgaatgagggtgtcggtcatgccgtcgatatcgccatcctgttccatcgtgcggaacttgtcgacatactcctccatcaggcgaatctgctcgtcgatggtgcgccggtcctcatcggtcggcgcgtccaggccttttgcgtgctcgtccggccaaccgatgagcacggcatccgcatactcaagcgacgcgcgctgccctgcggtcgcaatgccgtcctcgatctgcaccacgaacacataccgcaccaggctcaaccgctcggcagtgagtcggagcgcgatgaacgggtcatccaagtcaagcccccacgggttgacgggcgcgtcagacaccacctcggtcatgccgccggcaccgtcttcgcgttcatccaaccattccatcccttcctgcactccgttcatgcgcgcacctgcccattgccgtagccgacccatttcgtcgtcgtcatctcctggagccccatggggcctcgtgcatgaagtttctgggtggaaatacccagttcggcgccgaagccgaacaccccgccatccgtgaaacgcgtggaggcattcaccatcaccacggcggaatctatggccttcgtgaagcgttcgatgttcgtgtagtcctgggaaagaatcgattcggtgtgatgtgtggagtaccggttgatatggtcaatggcctcgtcgagcgaatcgacgatgcgcacgccaatctccaatgccagatactcggtgccccaatccgcttcgtcggcggcgagcaattggatgtccttgatgtctgcatctcccatgatccgcatcgacagctcatccgcatggatggtcacatgagcacgtgccaatgcctgagccattctcggcaggaactgccgggcgatgtccctgtgcacgatgagtttctccgcggcattgcatacacccacgcgttgcgtcttcgcattgaccacgatgtcgatcgccttgtcgatgtcggcagaggaatcgacgtagatatgcacattcccagccccggtctcaatcaccggaacgcgcgactcatgcaccacggattgaatgagaccggctccaccccgagggatgagcacatcgatatgaccggtggctcgcatcatcgcacgcgcaccttcccggccatagcggtcgaccgatgccacaagtgccggatcgaaatgcaattcctgcagcacctcgtctatcacctgtagcgtagcggcgttcgtgcgctccgcggcatggccgccacgcagtattgccgcattgccggacttgaggcacagggccgccacgtcgacggtcacattcggacgtgcctcgtaaatcatgccgattacgccaagtggcacacgctgctgctgcaatcgcagcccattacccagatcatagcctcgcacaatctcaccaaccggatccggcagggtggctacatggcgcacaccctgtgccgctgcggccacacgtatgacgtcgaatttgagtcggtcgagcttgccctgatccatgcctgcgtcaaaggcggcctgcatgtccatggcattggcgtcggcgatatcgcttgcatgcgcatccaacgcatcggcaatcgccatcaacacaccgttcttggtgtcggcggtcgcttgcgccagttcatgttgtgctatggccgccgcgtcggcgagcgcgttcactgcctgctgcacgtcgccgctcaccggggtctgtagctcattcgtattcgtcatagacccaagagtaatggcagttgcctacagcgcacaacggtttgttccattggacggacgcgtgtcggtgtgctccatacgctccacttataatgtgactcggcaatccgtctatcggcgaaggacacagtaacgcatgagcactttccacagcacacgcagcagcgacgaggcattcacatccaagcaggcgatacgcaagggcatcgccgacgatggcggcctgttcgtcaccgacgcccttggggagacgaagattgacatcagcgatcttgcgggtaaaagctaccagcagattgctttgacggtgttgtcggtgctgcttgacgactacaccgaggaggagctttcccagtgcatcgccgaggcatacggctcccaatggagcgatgagcgcatcactccggtcaaaccgctgggcaacgacttcatcatggaattgttcaacgggccgacctgtgcgttcaaggacgtcgcgttgcagatccttccccggctgatggcccgcaccactccggcggacggggattgcgatgagaagatcatgattgtcaccgctacctctggggataccggcaaggcggcgcttgccggattcgcggatgcgcagggcaccggcatcacggtgttctatccgcagggcaaggtctcccgcgttcaggaactgcagatgaccacgcaacaggggtccaatgtgaacgtatgcgcggtggatggcaatttcgatgatgcccagtccacggtcaaacgcatcttcggcgaccgtgatctcgcgtcacgccttgaggcggacgcgcatgttcgcctttcctctgcgaattcgatcaatgtggggcgtctcgtaccgcaggtcgtctattatttctccgcttacgcacagctgcttgaacagcaggtgatcaatgtgggcgaccaggtggacttcgtggtgcccaccggtaatttcggcaatgtgcttgccggatattacgccaaactgctgggcctgccggtacgtcaactcgtcgtcgcctccgaccgcaacaatgtgctcttcgacttcctcaccaccggcacctacaacagcaagcggccgttcttcgagaccacgtcgccgtccatggacattctcgtctcctcgaatctggagcgcatgctctactacatgagcgagagggatccgcgtatgatcacctatctcatgaacgatctcgccgaatggggaacctacgaggtgcctccggagatgctcatggagattcgcaaggtgttcgccaccggttgggccgatgaggatcaggtgcgcgagatgatcgccgactgctgggatcgcaaccactatgtgatcgacccgcataccgcatgcggttatttcgtgatgcagcagatgccagcggatccgcaggtgcctcgtgtgctgctgtccactgccagcccgtacaagttcccgcgcgtggtcaatgaggcgcttgggctgaaggcggatggcaccgatttcgaatgcatggacgaattgcacgccaaatcaggcacgccgattccgcagatgctgcggaatctggagaatgccgaggtgcggttccgcgactgcgtcgaggtgagcgacatgggccactacgtcgaggaatgcgccgaccggctatagtcatgcgcgatgcatatggggccggtccctccgcggagggaccggccccatcatattagtcaacgagaatcggactgtcgtgtttttcttgaatcatgtgagctgacgcggtgcctgggtgaagtcgaacagcacgccatcagcggtttcgcagatgcgttcccagtgcatggccgaggagtcgtcctgcactccccacacatgcatgccggcgcgtttcgcagattccaccgccgtgagcagatcctcgaacacggtgcaatgtgctggcttgacgccgagcaactgcgccgtgtggaggaagatgaccgggttgtccttgccgctgctgccgtcatcacccgtgcccacgaccacgtcgaacagatcgtagatgcccgcatgacgcatcgccggctcccgcagtgaggggagcatcgacgtggccaccgccagccgcgccccgcttgcgcgcagccattccagatatgcccgcgcgcccggcttgagctcgactgtcgtggtgtacgcctcataggcgagatcgttccactcccgcatgagttcctcgggcgtgtcgtcgagaccgaatctgcggatcgtatatgcggcgatgtcgtggaactgcatcgcactcaccttctgcatgtagtctgccggcacgtcgaatccgcgtctgccgaggaattcgacatccaccgcgtcccatacgcccatcgagtcgagcagcgtgccgtcgaggtcgaagatcgccgcccttccactgttgactccggctgcattcaccatattcgccatgtgccccccccctattcaatctcggattcgtgcagtagctcgcgcgcatgttccagggatgtcttcgactcgctgccggcgagcatgcgtgcgatttcgcgcacacgttcaccgccgctcacctcacgcacggtggtgtgtgtaccctctttaccggtctccttactcaccacatactggcgttcggcccacgatgccacctgcggtaaatgtgtgacgacgatcacctgattacggcgtgcaagtttggcgagacgtctgccaagttccactgccgccttgcctcccacaccggcatccacctcatcgaaaatgaacgtcatgcccgcgctcgcattctgagacgaatccgattcctgtgaggaatccgcggcacagagctccaaggcgagcataagacggctcagttcaccgccggatgcgcttttgcccatgggaagggacgccgatcccgggaagggggtgaagaggaattcgatgtcgtcgatgccggtggcgtcgagcatcccttccccgttgcggggtgtgaccacgatgtcgagtttcgctccggacatggcaagctgtccgagctcacggttcacctgggcgctcaatgcattcgccgcatcggttcgcgccttcgacaacgcccgcccgcgggctatcgcctcatctcgcagccggtcacgttcctgttccagggaatgcaactgttccggcgacgcgtcgagatcctctacgtcgatcttcgcgcgatcacgccattggagtacgtcggcgagcgtgggcccccaacgctgtgccaactcattgagatcatggatgcgcccgttgattgaatccagattacctgtctcaccgtccgcatcgagggaacgggatagggagaacacgacgtcgtctatttcagcgcctgccgattcaagacgttcggccaattgttcgtaatcccccaccgcatggatgccgcgcaacgactgcaccgcgccggcgatgagctgaccaacaccggctgcgccttccgcactctcgaattgcgaggcatccaaatatgccaacgcatgctcgacaccgctggtgatctgctcggcatgttcgatgcggtcacgctggtccatgagttcctcgagctcgccatcgtgcggatccacatggtcgatgcgtgctatggaatccctgagatagtccgcctgctggcgcatggacgactcctgcgtctgcagcctgcgcagccgctcgcacacactgcggtatttctcataggattggttgaacgattcacgggccttgtcatcgcgggcataggcatcgatgaattcacgctgtcgggcaaccgaggcgatgcgcagttgatcggtttgcccatgaatggtgatcaggttcgacgccacttcgccgagtaatgagcgcggcacgcttttgccacatagcacggaacgcgaacgccccttcgccggcacactacgcgagaggaagagcccatcgtcatcgaccggaattcccgcctcggcaagcatggcacgcaacggatcccgctcccccagcgcgaaaatcccctgggcccatgcctggtctgctccggatgccacgcgactcgcatccgcagtccctccggaaatcatgcgcaatgcgttgagtagcatggattttccggcaccggtctctccggtaatcgccgtcatcgacggcgcgggagtgattgtcgctgaatcaatcggccccaggtctcgaagttcgagctcctcaagcatgttcaccatccatgtcgtctactcacactgccgccggttggtttcgccgccgcggcatcgctgaaatctgcagcttcacagtataccgtgccacctcttagttggccaggctgatgcggctgacgagcggctcctagcactcatccacctcatccccttcgcctttgagtgaggttccctgcggatcggtgaggaggcgtccgtcggtgtcctcatgtttggaggcgttctgttcacgccagccctccaccggtagattgaatttggtgaccagccggtttgtgaacggcacgtcggagagccgcgccagtcggagtttgcttgcagattggcgaatctccacgcgcgtccccttcgccaatgccagctgacggcgcccatcacagcagatccagccgcctgaagtggagtcgtcatggatcgtgaactgcagtgtcgatgtggaaccgatcacaatcggccgggagaacagcgcgtgggcggccaatggcaccatcagaagagcctgcacatccggccagatgatcggccctcctgcagagaacgcataggcggtcgagccggtgggagtcgagacgatcacaccatcgcatccgaacgagctcatggccactccatcgatgccgatgctcatctccaccatcttgccgcggtcggcacgctctatcgtcacatcgttcaaggcccagtcgctcaaagcctcggtggtccccggcaaccacacgtcgacgtgggccaccatacgttcgtctatccggtaatcatggtcgcagatgcgccgaatcgcctcctcgagctggaagctttcgaattccgcaaggaaaccaacatgccccatgttgatgcctatgatcggcacatcggtgcaatgcaccagttccgcggcacgcagaatggttccatcgccgcccagcaccacgacgatctcggtttcgggaggaacggtctgcggcagcgtgccgaaatcgggaatggtgtccgtgtctaccagtgtgacatcgaagccgccacgttcgagctgcagcaatgtgtcttgcacaatggtgccggtctcacgcaatttcttatgggtcaccacaactgcatgtcgtaccttggccatcttcacctcgcaaacgctcttcgcatatcatagcccaatacatgctaggcaccgttccgtggaatcggaacggcaaccgtcacacaggctctcagtcagccccgaatgaagtggtcgatctggtcctgtttgcccatgatgatcagttcgtcgttgcgtttcaattgcagatcgttcgaagcatattggaattcatggcccggtgatttcacgccgacaatcgtcacaccgtacctgtcatgaatcttcgcctcaccgatcgtatacccgacgaattgcggtggcgtatggatcttgacaacgctgtaggcgccttcgagctcgatgtaatcgaggtaattgcctgagacgaggtggccgacgcgcttgccggcgtcggtttcggcgttgatgatgtgacgggcaccgatgcgctgtagaatacgggcatgttccttcgacacggatttggcccagatgtcggagatgcccgcgtccagcagattgcctgccgtgatgacggaggcctccaccgaatcgccgatggcgacgacggcggtgtcgaagtcggaggcgttgagctgctcaatggcgagcacgtcggtcatgtcggcctgcacggtgggaatctgcgatgaccatcggttgacgagctccggatccttgtccacggcaagaacatcctgtccaagcgcatcgagagtcgtcgcgacggcacttccgaatcgaccaagccccaccacaagcacactgcggttttccggcatgttcctccctttcctgcgcaacacgcgcttatctcatcacaccactatatccgccggtggggtctctcccccgtcgcggaatcgaatccatcagccgacgactatctggccttctgggtaacggaccacgtcgagttccttcggcctgctcacggcgtaggccagcgtcatcggacccagccgccccacaaccatggcggcagccagcacatagagcgacgcaggattgttctcctgggccacacccaccgtgtaaccacccagaccgaaagccgagcaggtgtcgaacatggcatggctcaacgaagagtccgtgatgagcatgagcgccaccgaggcgatgaacaccaaggcgacgcaagaggccgtaatcgagatggcggtcatgatcacatgctgcggtattcgtttgtggaatgcattgacatcggtatggccggtgaacgcggccttgcacaccagcagaatcacagccagggtcgtgacgcgtatgccacccgccgtcgaagtggagcctcccccgatgaacatgacaatgctcatgaacaccttcgtgcactccttcacccccggcacccaggacagatcgaagccgctgctccgaggcatcacggcagccaccatcgcacgccgcatgcgggtgtctacatcaccgtccttgaataggaccggattatcccattcgacggcaaggaaccatatcagtgacatgaatacgatggcgaaggtcatgatcatcgtgatcttggtgtgcagcgaccagtgcttcggtgatttgtgcatgcgcgccgtacggaaaatgttgagcagcacggggaagccgagcgtcccgcagaaggcgctcatcatgatcggcaaaccaacggcccaattgttcacgtacagacccgcaccatcgggtgtgaatcccgcattgttgtatgacatgacagcgaagaacaacgactcccacagtgtgcgccccacgttccccttgtttacggagagcaatcccgggaacagtgcgaagaacgtgacgacctcgatgacgagcgtggtcatgagcaccacctgcagcacgccgcggatctccgacagcttgttggtgccgagttcattcgccgccagcaaccgttgcatggctttcaaatggtggttgacggccagggcaatgagcgaggcgaaggtcatgacgcccaagcctcccatctgcaccgagaagatcagcaccacctgcccgaagatcgtccaatggtccgtcgtgttcaccaccgagatgccgcaggtggaaagagcggaaaccgcggtgaagaacgcagtcgagaacgaggtctttttgccgggctgggtggcgatcggcaggcacagcaatgaagtcgagactgtgatgagcgcgaggaagtagatgatggtgagacgacccggatgcgagttcagtcgataggacagcgaacggctatgaggattgcgctcctcataggcgttgcgttcgaaggtgtcaccagagaaccaccaaccgaatcccttggaggtctcggagttggatgccgattcatcgaacaagagattggccatgcgtcctcctgttcgtcaccggtcaatttcgtctgcgggcaggtctgggtcgcggcgcgcccgcagcggtccatgccgcaaaacggcacgcgacagcacctgtttgcataagccattgtaggaacacaagggaccaaaagcgaattcaccgctcatcgaaacagatgcctgtcaggaggtgtcgccacaactcctcgcaggagtcccgcaccgccgacgctcgccacgttttatattccataacgcagcatatggaatcacgacgattgcgacatacgcagatagaggagatattcagcattgccatgggtaccttcgatcggagagggagcactcgccacaacctgcagaccgtgttcgcgcgcacagcgttccacccgttcgagtgcctgctctcgcaacgacggatcggtgacgatgccgttcttgcccagtctccccttctgtcccacttcgaactgcggtttcaccagcagcacgatctgtgcggcgggggctgccacctcggcaatggcggccatcagatatgtcagggagatgaacgagacgtcggagacgatgacgtccggccgatatggcaggtcgtcgacccccacataccgcatgttcactccgctcatctcgatgacacgtggatcgtcggcgatacgtggatcaagctgcccgtggccgacgtcgagcgcgatcacctgtgcggctcccctacgcaacagcacatcgcagaatcctcccgtcgaggcaccgatatccaggcaatgcttgccttcaaccgaggtgaatcccgctggcgcgaacgcgttgaatgctcccagcagcttgagtgcgccacgcgacacataatcgtcttccatggccatgtgcacactgatggtcgattccggctgcactgcgtatgccggctttgtctgtggatgcccgttgacgtgcaccttgcctgttttgatcagacgttgtgccttggatcgcgattcacctgtcgcattggcgaccacgacgtcgagacgctcttcgcgcatccccgtgtgttcatattccatatgggtcatgctgattcatccacgacacgcaggcaggctcactcgccgagactgaattcaggcaatgcgaatgcagcgacatcctgcccgctgtccgcagcttgccaagtcaaagcgcaggccgcccgcagcgcattgacatcgttggggtcgttcacggtgagtcgccgatgggtcagactggcctgcgcttgcgcgcaggttgcccgagtgccggcttcatccacgtcgattcgtgggtatgcctcattgagaccgcgcagatcacgcacaatgtaggtggggcgcagatgcttcggagcgcacatcagttcggtcggattcgtcacaccggtgagcacggccagtgagtcgtagccaccgcggttgcccgcctcgatgtcggtgtcgagacgatccccgattgccaggctccttgctttgcagaccggttctgtgtcgccttgcgcggcaagttcgcgtgcttcgtcatacatggccgattccggtttgcccgccgaggcgatgggttgcacgccggtggcattgatgactgcctgaatcattgacccgcaacctggtgcgatgccagcttcgcgtggaatcgtcaggtctcggttcgtcacgaaatacatggcgccgttctcgacggcgaatgacgcctccgccagcatctgccaagtcatctgcgggaaccatccctgaatgaccgccgtcggatgatcgctggcgtattgcactggtgtcaggccggctttgcccacctcgtcctgcaggtgttccgcgcccaccaccaacactttggcaccctgaggtacatgcttggacaccatgcgtgcagcaacgaccgacgaggtgatgacctgccagggctccacgtccagtccgaaaccacgcaattggtcggccacgacagactgcatccgcgatgaattgttcgtcgtgtattcaatggtcatgccgagatgttcggcctgacgaatgctttcggaggcaaaggccaccggatccttgcctcgatacacgaccccgtcgaggtcgagcagtgccaaggaatacgtctggctcaacggtgcttcggtggccttcaacaatgtcactccgtctcttccttgatctcctcctcggaatcgccgatctcggcgtcctcctcgtcgatgtcgtcctgcgcatccgtcagatcgggatctgccatcagaccctcctcgtcgcgacgagtattgcgctcctgcatttcagctggttcaatgtccatttcggcccctgcacgctgctcctcggcggggatgcgcgtctcatcgtccatgttcacaccatcctcatcgtcgaacggcgcatactgggcgtcatctggggtgacacccagcttggcctgcagatcctcgggaagatcctcgacgtcgtagtccaccacgaagtcatcgtcggtctcatcctgttcgacgtcggcatagcgatcctcgagatcgtcaatgagctcatccatcgccacggcctcgtcactgcgtcccgattcctcgaggaagtactgctcggcctgagcggcgcgcatacggtattcgcctgcaaggcccttggcatgcacgagcttggacacgacctcaatggcctgattccacaacttgagatcggccaaggcaccagcgtagaccaagaacatctcggccttcgcctcaccggtgagatgcttcgcgtcatcacccatgcacagctcgatggccttcttgggcttgccgaggccacgctcgcaatcggccatgaacggcaggtaatccaagtagccgttcatgcggaacgccgtctggaattcgcgcaatgcaagcttgtagtcaccctgacgatacgcgatcatggcgagcgtttcgcgggcgatgtcgacacgggacgcctgcttggcggcccacttcgcatgggctagggcgcggtcgggatcgtttccctccaaggtataggcagccaggatgtgcaagccgatgttttcggcatgctccttggacaggccgcgcagtcgctcacgctcgtccttgctgagcatgctccattcgagtcccttcggcagttttggctctcccgggcgcagatggtcgtatgggttctgcgaggggaagctcaccgtcccatcggagttcttgcgcgattttgacatgtactcatcgcgcttgcgatcgtgatatgcctgacgatcctcacggttgaactcgcgacgttcgttgcggttgttgcggtcgccatgacggtcgttgccgcggcggtcatcatcgcggttatagcgcgggttgttacgacggtcattgttatggccggcatggtcgaagcggtcatatcgacgctcgccatcatgacgcccgttggaacgatggtcgttatcatgactgaatccgcgatgttcaccatccccgcggttgtcgtcgcgattaaaacgacgatcgccatcgttgcggcgcctgaaaccaccattaccgcggcggtcatcatcgcggcggaatccgcggcgctctccgttgccgcgacggctgccatcacgggaatcgcgacggtcgtcgcggctgtaacggccattgccatcccgacggaactcaccgtcaccttcatggcggtagccgcgatcattgcggttatgggagttgaagcgggagccggaattgccgccacggtggaaaccaccgccattgccacggccacgggagccggaattgcccctcgagttaccgtaggaacgcccacgggagttattcgaattgcgcgaaccacgttcgtctgccatgttgcacctctgcgtaagagacgggccttcgcccgccttcgtgttctaggtctaagtctaactgatgcaggccatgcaagcctgttttcttctatgcgtcaaaaggcgatgcggccaatggtgtcaggcacggcatcagctgcgtgccacgacaccgagggccttcttgccacggcgcagcaccacgaacctgcccttgaggaaatcaccatcgccaagcaactgctcctcatcttccacacgcacattgttcacgtacacgccaccggacttgatcgtcttgcgcgcctccgagatggacttgaacagcccggcactcacaccggcctgtgcgatccggtctccgggaagggcctgtgcgaacaccttttcccccgcctcattctcgactttgagaccgtcaagcacactttccagagtctccaaatcgatgtcggcgagatcgccgccgcggccgaacaacgaagccgaagcgtcaatggccttgcgggtgggctcatcgccatgcaccaagctcgtgacttcccaggcaagcacccgctgcgcctcacgggcgcccggattcgtgtcggtggcctcgacaaggcgctcgatctcggccttcggcaggaacgtgaacgccttgagcaggctggccatctcgacatcgggacgattgagccagaactggtagaacttgtagacggaaagcatgttggggtcaagccagaccgcattgccttccgattttccgaacttcttgccattggcgtcggtgatgatcgggctggccatcacgttgacattgacgccgcgaaccttgtgaatgagatcgagaccagaggtcaggttgccccactggtcggaaccgccgagctcgagcacgcagtcgtaatgatcgtacaggtacagatagtcgttgccctgcaacacctggtagctgaattcagtgaaggagatgccctcttcggaattcaagcgacgggcgacgatgtccttcgagatcatcgttcccacgcggaagttcttgccgatgtcacgcaggaagtccaatacgttcatcgtggcggtccaatcgtagttcgagacgaaggtgacgggattggagccctcctgttcaaggatgccgccaatctggatgcgcaaacgctcacaccactgttccactatgtccttggggttgaggatgcgttcgccggactgacgcggatcgccgatcagacctgtggcaccacccaccaatgcgatcggatgatgaccggcttcctgaaggtggcgcatgatgatgagctggacgaggttgccgatgtgcagcgatggtgctgtcggatcgaaaccgcaataatagtggaccggctctccgttgagtgtgtgcgcaagccgatccctatctgtggactgagagatcaagccgcgccattccaattcatcgagcacggaatcaaatccggcttccttgaaatcgatgacgtgagccatacctattctcctcgtgtgttgtgatcccgcgattgacgggcagtcttagtgtgtcataggttcacgacacctggaaccctctatttgcttagggtttagcggcatggaaacgggagggcgacagggtctcacgtatggcgcacagggtgtcggcgatgttgacgatgactccttcgaggtatttcggaggaatgggtgtgagggggaacatgtgggtgcgaatcgagttggacacgatgtcgtcgagttcgaagtcggcacgggcgttgcgttcggcagtatacggatgccggaaaccatgcagcctgtgcgacccgttgtctttctcatgccaatcgtacaggaagtaatcgtggagcagcgctgcccggacaagcgaacgcaggttcacatgatgccaaaggtggaggcgatctgcgattttcacactcagacaggccacggcgatggaatgctcataggtggtcacggcaccatgctgcaacgagtccctctcgatctgcatctgctcatgggagagaatatcggcaccatatgcgtttacgatggcatggattccgccgtcatcaagcatgccgcctccttcgccctggtatgtgccggcatatgcggcgagttgcatatgcgatgcatgcgcttttccaatataatcggattcgatgtaggtcggcggcatgttcgttcgcagacaacggtgtctgcacatgcttccggacggaaaggacgctatgactgacatcagggttgcaatcgtgactggggcggcgcgcggcatcggacgcggcatcgccgtcaaactcgctaaggacggcttcgacgtcgccgtggctgacctcgagggtcagcggcaggaggccgaggagacgatccaccggatcgaacaggagggacgccgggcattcttccgccccaccgatgtatcacagcgtgatcaggtattcggtttggttgacgataccgtaaatgagctcggcacgctggatgccatgatcaacaacgccggcatatgccagatcaagccgatgctcgacgtgacgcaagaggagcttgagacgatttaccgcatcaacctgttcggcatggtctatggtgtgcaggcggcggcaaagaagatgatcaagctcggcaagaagaccgggcacatcgtctccgcatcctcgatcgccgggttcgagggcttccccatcctgtcggcatacagctcgacgaagttcgcggtgcgcgggttcacgcaagccgcagcgcaggagctcgccccgtacaacatcacagtcaacgggtatgctccgggcattgtggacacaccgatgtggacgttcatcgacgaggagatgagcaagctcaacggcaaaccgctcggacagaatttcaaggacatggtcgacaccatcgcattgaagcgctgtgagactccggatgacgtggcgggtgtggtttcattcctcgtcagtgataatgcccgctatgtgacaggtcagaccgtcattgtcgatggcggcatgcagtaccgctagccggttcagcactgcatacggcgatggggtgcgaccggcaatccggcccgcaccccatcgccgcttcatatgctatcggtcactcattgcttattgagcgagccgcaggccttgtaggccatgccgtcgctcttcacctggaagaagctgcgaagctgctcgatgagcgtcttggcgctcatgatctgctcgcgaacacgattcggcgcggtgccgcccttgccggctcgggccgataccgatccttcggtggagagcacttcccgaacctccaccgcgacatccggttcgacgaagccacggaaaatctcaatgaaatcgtcatcggaaagatcccatagctccacccccctgttttccgccaccttgacgcacgcaccggaaagctcatgggcatggcggaagggcacaccgttcttcaccaaccattccgcaatgtcggtggccaacgcgaatccggtgggggcctccttctccagccgctgctcatcaaagcgcatcgtacgaatcatgcccgtgaatgcgggcagcagcacttcgagcgtgtcgacctgatcgaacacggcttccttgtcttcctgaaggtcgcgcgtataggctgtgggcagacctttgagcgtggcaagcaggccagtgaggtcgcctatgagacggccggccttgcctcgggcgagttcggcgatgtctggattcttcttctgaggcatgatcgacgagccagtggaataggcatcgtcaagcttcacgaaaccgaactcctgggtattccagatgatgatctcctctgacagacgcgagatgtcgacacctgccatggccatgacaaatgagaactcggcaacgagatcgcgacttgcggtgccatcgatcgaattctccgtcacgttggtgaaaccgagctcccgggccacggccacgggttccaatcccaacgtgttaccggcgagggctcccgaaccgtatgggctggcgtccacgcgctgatcccagtcgcgtagacgctccacgtcacgcagcaacggccagacatgggctatgagctgatgtgcaagcagcacgggctgggcatgctgcatatgggtgcggcccggcatcaccgtatggccggcgtccttggcctgcacaataagcgcatcggcaaggttgagcagctggtttgcgaccacgcgggcatgacggcgcatccacatgcggatgagcgtggcgatctggtcgttgcgcgagcgaccggcacgaagcttgccgcccaattcgtcaccggcaatctgcagcaggccgcgctccaatgcggtggcttcgtcctcgtcgtcgtcaatcggcgtgaattcaccggaatccacctgacgctgcagttcatccaatgcggcttccatgcgctgcaactcatctgcggtgagcaggcctgcacgccccagagcgcgggcatgggcacgggaaccggctatgtcatcgtcagcgagacgccaatcgaactgagtcgacttgctcagcaatgcgagctcgggcgaggggccggacgagaatcgccctccccacaaagccaggtgatcctgggattcgggcttgtgatcgtcgctcatatctctccttttgcgaagacggccatgccgtccgtgttggcttggaatacgaaagaagaggcgttttcacgcctcttccccgcataagcattccatgggaactgcgccgtgagactactctacgtcgttctgcggaacttcgatgccgttgccgaagcgaacatcccgggctgcagcgaccttcgtcggcagtccgtagatctcgatgaaaccgttcgaggcattctggtcgaaggtgtcaccggaatcgtaggtggcgaggttgtagtcatacaacgagctgtcggaacggcgtcccaccaccacggcacggccgccgtgcatgaccatgcgaatctcaccggacacataccgctgggtgtcattgatgaacgcgttgagcgaatgcacggccggggagaaccattgcgcatcatagaccagttcggcccagcgcttatcgatgccgcgcttgatgcgatgctgctcacgttcgagacacatgttctcgagttcctcgtgggccgtgatgagggcgatggcaccaggtgcctcgtagagctcacgggacttgatgcccaccaggcgatcctcgatcagatcgacacggccgatgccctgagcaccggcgcggcggttcatctcctcgatggcctgcaacggcgtcacctcgcgaccatcgatcttgaccggcacaccttccttgaattcgatgaccacttcgtcttcgacaggcgggaagtccggatcatcggtgtaggaatagcaatccttggtgggcgcattccacgggtcctcaaggaaaccggtctcgatggcgcgaccccacacattctggtcaatcgagaacgggctcttctcggtctgcacaatcggcaggtcatgctcattcgcataggcgatctcgacatcacgggtgagcgaaagatcgcgaatcgggctgatggccttgagctccgggtctatggactgaatcgacacctcgaaacgaacctgatcgttgcccttgcccgtgcagccatgggcgatcgtgtctgcaccgaactggtgcgccgcacgaaccagatgcttggtgatcaacgggcgggagatggcggagaccagcggatagacgccctcatacatggcattggccttcagggcctgcatgcagtattcattggcgaattcgtcgcgggcatcgacaatatatgcctcgacggcaccgcatgccagagcgcgctccttgatcgtctcaagactctcaccaccctgtccgacgtccagagacactgccactacatctttgcctgtgcggtctttgaggtatgggattgccacggaggtgtcgagacctcccgaatatgccagcacaatacggttcttgtcgctcatattcagcctttcacgattgcagttgatattacaactatatacggtctactgtatatttattcattttcgacacgcaatctcacgatcgagatgagattctgagcatccattcggctcggcgaccagctgtggtgtcatccgaacagatgatgagtatcgtatcgtcgccggcgatcgttcccagcaccccgtcaatcgaatgcttgtcgatgccgctggccacatactgtgctgcgccggccggcgtgtgcacgatcacgaaattcgaggcgtgggccacggagacgacaagaccggtgagaatcttggcaagctgttgctcaccccgtccctgaccattcgattcaggcacggtggccagggggacctgatcggccacagcgtaggcaatggtaccgtcggcgagtctggtcttggcggcgttcacctcatcgagatcacggctcattgtcgcctgtgtgacggggaagccctcccgtgcaagcagttccgacaactgcgcctgtgacgtcaccacattgtcggccaaaagctgacgcaccatctgcagacgcgctgcacgcgtgctcggtcggccgacaccacttgcgccgttgcttgactccgatccggtctgttcactcaactgcgtactccttaatctttcagctcagcagactctcatcaccacgctgcttgccgatgagccatgtcagcagtgctttctgcgcatgcagacggttttccgcctcatcccagaccaccgactgcggtccgtcgatgacaccagtggtgacctccttgccgcgatatgcaggcaggcagtgctggaagagcgcatccggcttggccagacccatgagacgttcgttcacctgatatggccagaacggcttcgagcgaatcgcgtattcggcttcctctcccatcgagacccaggtatcggtgaagatgcaatccacaccgtcgaccgcctgctctggatccacggtcaccatgatgctgccacccgtggtctcggcgatggcctgggcatcctcgacgatcttctggtccggcaggtagccgttcggccctgcgacacgcacatccatgccggcgaccgcgcccgcaagcaggtatgaattcgacatgttattcgcggcatcgcccacataggcgatcttcagattctccagattgtccacgccgcccttgaactgcgccagcgtgaggaaatccgcgagcacctggcagggatggaactcgtcggtcagcgcattcaccaccggcacagtggcgacacgtgccatctgttcgacacgggactgctcgaacgtgcgccacacgatgccgtaggccatgcgtgtcagcacttcggcggtgtcggcaaccggctctccgcggccaagttgcgaaccggacttgtcgatgaccagggggtaaccacccaactcagccacgccgatggagaagctggaacgcgtacgggtgcttggcttgtcgaagatcaccgccacaccctgagggccctcgaagggtcgatggtagaaccgatcggcacggaatttcatgccgagttcgagaatctgcttctgctcctcatggttcacgtcgtcgtcgcgcagcatatgacgcagttcgcccattgcaacacttcctttgctatagagattggttaccgatgctcagataatcgtatgcgcccactggcgtgggtcgctagcgtatttcagtcattgggcaggtcggaggggatcgcagccagtacgtggaccgcctcgtcaacatcgttctcgctcaccacgagcggcggtgcgagacgtagggcgttaggtgccacggcattgatgatgagcccgtgctccagtgcccaatccattgccgcatgcgcgcagggatgtgtgagcacgatcgcgttgagcagcccacggccacgcacggattcgaacagcggattgccgcatgcgcgaatctgccgccgcaactgttccccgcgcgcctcggcgttgacgagcaaatcctcacgttcgattacaccgatcgtcgccagtccggcagctgcccccaacggattgcccgcgaaggtggaaccgtgggtgcctggcgagaacaggttgctgagctcctcgccaaaggcaatcatgcctcccatcgggaatccgccggccacacctttcgcgaacgtgaccatgtccggcgtaatgcctccgagatcgtcgcgttggaaggcgaaccacttgccggtgcgccccatgccggtctggacttcatccacgataagcttggcgtgatgttcatcgcacagactcctcacaccgcgtacgaattcaggatccagcggcagcacgccggcctcgccttgaatgagctccatgatcacggacgccaccggacccgaatctgtcgcctcgaacgcagcacgcatcgcatcgagatcattggccggcacgaattcgaaatttggcaccaacggttggaacggttctcgaatcgccggcttccaggtcgccgaaagcgcgcccatggtgcgcccatggaatccgtgttccagggcgataatacggtacggcttatcggcacccagactgcggccatagagcttggcgagcttcaacgccgcttcattcgcctccgcccccgaattgccgaaatacacatgggagccctgtggcgcaccggcgagttcgacaagcttggcagccaaggagatttgtggtctcgtggcgaaatagttgctcacatgggcgacctgggcggcctgagcggacacggcctcgatccacgcggggtgtgcgtacccaatggagttgacggctattccggcaaggaaatcaaggtactcgttgccatcgacgtcccaaacatgggtgccctggccatgatcgagcactcgaagcggcgtgccgaacacatgcatatgcacttgctcgtattcgccgatcagttcggtgtcatgcgtcagatcaatttgttcagaggtcataggagctccttaattccatgccctcgccgggctccaccatggtgcccacaccggcggtggtgaaaatctcattgagaatggagtgcggcttacggccgtcgatgatatgggcctgctgcacgcctccatcgatggcccgtacacaggcctccatcttgggacgcatgccggattctaattccggcagcagatcccgtaggtcctcgacgccgatacgtccgaccagcgagttcttgtcgggccagtcggcatacaggccgtccacatcggtgaggatcacgagcttatgggcacccagagccgaggccagcgcggctgccgctgaatcggcgttcacattcagcacctcggtggcatcgtcctcgttgggggccacggaggaaacgacggggatgcgaccggcatggatgaggtcgacgacggcggaggcatcgacccccaccacatcgcccaccaaaccgatgtcggtgggttcgccgtcgatgatcggcttgcgctggctggccgagaacagggccgcatcctcacccgaaagacccaccgccaaaggtccgtgggcattgatgagcccgacgagctcgcgtgacaccttgccggtgagcaccatgcgaaccacatccatcgcctccggagtggtcacgcgcaggccgcccttgaattccgaatgaatgcccaacgccttgagcatctgggagatctgggggcctccaccgtgcacgaccacggggtggatgcccacctgacgcaggaacaccatgtcttcggcgaagcactccttcaagtggtcgttcaccatggcattgccgccgtacttgatcacaatggtcttgccgaagaactcctccagccatgggagtgcctcaatgagtacctccgctttctgatcgggccccagatcggtatgcacatcgagatgatacccgggtccgcgcaacgggcttgccatgagtcacactcagctttcgtaatccgcgttgatatgtacatattcgtgggtaaggtcgtcggtccacacgcaagcttcgctctccccggcgttcaggtcgatgtctatgtcgatctcgcgcagcgtcatgtccacctcgctccggtcccggtccggaccgccattggcgcagattctcacgccattgatggtgactgagacctcgttcggatcgtacggggccacatcggcgggaacggtgccgagggaactgaccacacgaccccagttcgggtcattgccgctgatggcgcacttgagcaggttcgatgcggcaaccgctcgcccgcacgccaatgcggcatcctcactggtcgcaccggtgacccggattcgaatgtcatggctggcgccctctccgtcaccgatgatctgcctcgcgagactggagcaacaatcggccaccaagccgttgaattcgtcggggtccggagtgattcccgaggcacccgatgccagcagcagcacggtgtcgttggtcgacatgcaaccgtccacatcgatgcggttgaaactacgatcgacggcggcggtgagggcggcctgcagctgacctgccgagacgacggcatcggtggtgatcacgcatagcattgtggccagctgcggggcgatcatgccggatcccttcaccatgccgccgatgcggaattcattcgaccccagacgattcaccgttttaggcttcgtgtcggtggtcatgatcgcatgagccgcatcactgcctgcctgggcgctggaatccaatgagtcaaaggccttctgcgcgccttcgatcactttgtcgagaggcagcagttcaccgataaggccagtggaacacacggctatctccgacggctccacatgcatcatcaacgcgacggcttccgcggtgcgcaccgtctgctggtacccttcctctcccgtgcaggcgttggcgcctccggaattgagaatgaccgccttgagctctccgtctgaaacctgcttgcgggaccactgcacgggtgccgcacagaaacggttcgaggtgaatacgcctgccgcggcattgagcggcccgttgttgaccaccaatgcgacgtcctgcttgcctgtctgcgaggagatgccggcaaccacaccagccgcctcgaatccctttgcgaatgtaacgctcacggtgccactccaatcttgctcaatcctgttgcatcattcagtccgaatgcgatgttcaacgattcaatggcctgccccgccgtcccccggttgaggttgtcgatggcggtgaaggcatgcagtgtgccggatcgtcgatcgacagcgacctgcacatgggccgcgttcgacccgagtacgttctgggtggccggcatgacgccgggatccagcacgaagatgaattcctgaccttcataggcctgcacccagatgtcatggatctgttcatcggtgagcgcgagggcctcatcggtgagctttgcgctcaccgaggccaggattccacgtgacatcggcacgagaatgggggtgaacgcaagcgagaacatatcggcctgtgacgcaccaagtccggctgcatgggcgaaattctgcagtatctccggaatatgccggtgtgttccgcccaccgaatacggcgacgccgaccccatggcctccgaagcgagcagattggtgcgcttgaggttcttgcccgcgccggaataccccacggccagatcggcgacaatgctcttcgtatcgacgagcccttgggcaatcgcaggctgcaatgccagcgtggtagccgtcacgttgcaccctggaccggcgatgcgcttggctccggtgagttcgtcgcgctggcgaacatacttgccgtcggaaccgattccaagaatgagctcaggcatgccataggtccaatgctggtagaaatctcccccataatagtcgtcccacgcctgctgccgctcaagtctatggtccgcacccagatcgaccaccaccgcgtcatcgtcaagctgcgccgccaaggctcctgaggctccgtgaggcagcgcgaggacgatcacgtcatggccgtcgagcacggctggcgtagtgtcctccacaatgagatccgcgagttgcggaatatgtggctggtattcccccagtcgatgccctatggacgaatggccagccaccgccgtgacctcgaaggccggatgggcggccaggatccgcaacgcctcccctccggcatagcccgtagcccctgccacggcaaccgtgtatttcgtcatatgctcttctcccatgccgacgtcattacaactttgcccatatcctaacaaatatacagtacattgcataaacatgcatgtctgaatgaagtcagaatatgggcaaagttgatttaaccactggaatactaggcttttacggaatcagatccaccggaaccattattcaaagtattcaacatttggttgagatattcagttggtgagacacctgagacaaggaagtacagccacatgatcgtatagagcacgttgatcaccagcgccgccacagccaatccatagcctttcatatggtagattttcgtgcgacgcatgctgaaccatccgaagagcgccggcagcaccggtaacgggagaatcagcgcgaacacgaacgcgatgatggcgcccggatcccagtgcccatacagcggattctgattggggtcgtccgggttcatctggttcatgctgttgatgaagcttgggtcgttcagattgaatggcggctggtttcgtcctccattgccctgacgtccggaaccgggctggttctgggtctggtacggcagtccggcctgctgtccgtaggcattctgttgggacggctggccatactcgttcccccgctgggcctgggctcgcgcagcggctgcccccaaagcatcgtcagtgtccggatgcccgtagatatacggatcataggtggcagggaactggctgtccaaagcgccgtactccaggccattggaggaaccgacgctcggcgggtcgtcgtcgaaacgcccatcgagcaccagccccctcacatcgtcctgtgcggcatccggattgattgcatggcgttcgccgtgggcggtcggagcagcatgatgctggtcgttcggctcgttcggaacaccgttggaggtgtcatgctgctcttgttcgctcatttccctacctcatttcatatgctgggatgcctgccgacgctaagcacgcaactgcgcaccaagtgtagccgtcttctcaacaatacgctgtcggatttcctcactgtcttgcgacgtgagcgtgcgatccggtgcacggaatgtgacggcataggccagtgacttcttgccgtcccccacctgatcgcccgtgtacacatcgaagagctcgatggattccagcacatcgcccgccgcctgacgaatcgtctcggtgagttcgtgcgccgtgaccgaggtcggcaccgtgaacgccaaatcctgcttgaccggcgggaaggtggagatcggcttcgcctgaaccggcttgttgctcagagtggagaacagagcggtcagatcgatttcgaatgcggcgctatggcgtgggaaaccgagtgcatcgtccaccttcgggtgaagctcacctacaacaccgaccggggtgtcgccggacatgatgcgcgcgacgcgacccggatgccattgggcacctgccttgtcaccgtccgactggtcgagcacgatcttcgcacccaaacgatcggcgatgcgatgcacagcctcgacggcatccgtccaatccacaggacgcttgtcgcccaaccatccatcgtcctcggcattgccggtgagaatggccgcaacgtgcagcggctgctcgggcaaccctgcatcaagagccgagagctgatcgtcgctggggcgctgtgcgccggggagagccggaacggcaggagcttcaggatctgccagatatacatgcccaagttcatagcaacagatgttctcgagaccgcggtgcaggtttcgttgcaccgtagtcgccagcgtgagcagaacctgccgacgcaggaacgggcgatcgcctgcgaggggattgactatctcgacgctcaccttttcgacctcttccgagtcgatctggaagttcttgaagtccgctttgcccacgaacggatagctgagcacttccaccagaccatattcggcaagctcgtcggccacctgacgcttgtgcagctgatcgtcggtgagtccgacatggccttccaccggggcatgcgggactcgtacaggaatacggtcgtacccatagatacgggccacttcctccaccagatcgcaggctgcggtgagatcggggcgccaactgggggccgtcaccgagaattcgccattgccacctccggcgacactgcatccgatatcggtgaggatatcgctgatcttgttgatgtcaagatcgagcgaggtcagtcgcttcacctctccggccttgaaggcgatcggatggccacgcttgacgttgttcacgtctcgcggggtgtcgctggccttcgcgtcaccgtatttggtgagcaagtcgacggccatctgagccgcagcgggttggatctgggtgtccaccccgcgttcaaagcggcgggaggcttctgagggaatcttatggcggcgtgcagagcgtgccacggtgatcgggtcgaaatgcgctgcctcaagcagaatgttcgtggtctcgtccgtcacctcgccatattctccacccatgacaccggcgatgccgagaatgcgcgatccctgctcaccattcggggaatcggtgatgagcagatcctcgggatctaggtcatgcttcttgccatccaatgtgaccagcgtctcaccagccttggcgcgacgcacgacgatcggcccgctgatcttgtcgaggtcgtacgcatgcatgggctgccccagatcgagcatgacgtagttcgtcacatcgaccggcaggctcaacgaacgcatccccgctcgcgacagacggtgacgcatccaattcggcgtcgggctgcccggcttgtagtcatgaaccgcacgaacatagaaacggtcgcatccgaccacaccatggatcggattgtcgtcatcgatgatcacatcgatgtcgtgcgtctgaccgttctggtcctcaagttgtggcgcacgctcttcaaaggcggccaccggatcggtgaactccgccccggtggagttgtggaactcgcgtgcgatgccgcgatacgagaaggcatagccgcggtcgggggtcacattgatctcaagaatcggctcgtcgagatgcagcaggtgcatggcatcgtcgccaggttgcaacgcctcgtattcctcaggcgtgaagccataatcgcgcagcagtatgatgccgtcatggctgtcgcccaaaccaagctcacgttccgaagcgcacatgccgtcggagatatgcccataggtcttgcgtggctcaatcttgaaattacctggcagcactgcgccaggcagtgtgacgacgaccttctcgccggccttcatgttcggcgcgccgcagatgatgccacgtggcaccttattgccatgctcgtcgacgtcgttgtattcctccccgacatccacatggcaccagttgatgaccttgccgttcttctgcggttcaggggtggcgtccaccacatagccgacgacgatgggacccgtcacgttgctggtgtggatctcctcctcctcaaggccgacccgcaccaggtcacgggcgagttcctcataggtctcgttctccggcacggccacatgctcacgcagccagcccatatctaccattggcatattctcactcccccatcacgaactgttcactgaaacgcacatcaccctcgacgagatcgtgcatatcgttgatgtcatggcgcagcagcaacgtgcgctccacgcccacaccgaaagcgaatccggtatatatgtccgggtcgatgccggctgaacgcagcacattcgggttgaccatgccgcagccgccccattcgatccacccggggccgcccttcttgtcggggaaccacagatcgagttcggcgctcggctcggtgaatgggaagtagctcgggcgcaggcggctcttggcctccggaccgaacatcgcgacggcgagcttgtcgagcacgcccttgagatctgccatggtgaggttcttgtccaccgccagcgcctcgacctgatggaacaccggggtgtgcgtggcatcgagttcatccgtgcggaacactcgtcccgggcatgcgatgtacagcggcacgccatgggagatcagcccgcgcacctgatccgacgacgtctgcgtgcgcagcaccatgttggagccgacaaaaccggcggcatccttggactggttgcccttcacatagaaggtgtcctgcatctggcgcgccggatggtccggaccgaagttcagcgcatcgaagtcgaaccattcggtctccacctcagggccgtccgaaatctgccatcccatgcccacgaagaagtcctcgacgtcctccatgagcttgggcagcggatggcgggcaccaagcggcttgcggcgaatcggcaacgtcatgtcgacggtttcagcggccagctcggcagcctcctgggccgccttcacgctggcctccttcgtgccataggcacggccgaaatcggcacgcagcttgcccatgaccttgccggcttccttcttctcgttcttcgccaacgagccgatcgccttgctggccctcgtcatcgcggaatttgcacccgcgtacttcgctttgatggctttcagttcctccatcgtggaggcctgttgtatcgcggcgatgccttcggcgatgtctttggacaccgcatcggcgtcgaatactatgccttctgccacaagaaccctttcctacatcgtgcacacatatgcaaaaccctgttgcgacaatagagaaagtcgcatcattccaacggtttaccgacttcccattgtttcaatacgactcgacatggccaacgtggtgagcatcaccgccgcactggttcccagattgagcgattcggctttcccgtagatcggaatggagacgctcatcgcgcattcgtcaagcagttccgtggtgaggccacgggcctcattgccgaacaacacggccttggacccctcgaccaactctctgttgcgcagcagatccggcagactcaccggaggcttgccctcggtgccgtacacgtctgcggccagcacggtggtatcgcgctccctgcacaggtcgaagaacgcccgctcatccatagcaagcaccggcagatggaacaacgagccggtggtggcacgaatcactttcggattgaatatgtccacgcaatcgcccaccagaacgacggcgtcacaaccagcggcgtcggcactgcggatcacggtgcctgcattgccggggtcgcgcatctgccagaatgcggcaaggaacggatggggagtctgcggaacccgtccaagcaggtcacggcaggaattcaggtcggcaaccgcaaacaccccctgggcatcatgggaaaccctgtgctccacctcctgcgtcatcttgtgcacatggatccgctcctccatcgcctcaccggcaagcttgcccaacgcggtcgaggcgatcggggaatccggatccgccccatcggtgcgcacatagacatcttgaatgatctgtggctgccatgtgagcgcctcgcgaacgcactgcggcccttcgatgaggaacttccccgccttctgacggtgctttcggttggtgagttcggatatgcgacggatacgttccgccttggtgttcgtgagtacctgctgatctatgggcataccgccagcgtagcgcgcggtgcccattttcagaaagctcccagtaaacatacgggaagatgccagcgcgtttgccgctcctcacaacccgcaccggatacgctatgggcaaatgcacaccattccgatatttgtgttttgcataaggagagtcatgttcattgtgcacaacgccatacggaatctatggcgcaacaaaggacgcagtgtgctgatcatcatcgtggcgacgatcatcgccgccgcttcgacgatcggcttcgccattgttcaggcggcacaacgcgcccgtgcctctgcgttggagaacacgacgatcggcgcgcagatctcgctggaccgaaacaagatcatgcaatccgcgaactcctccgggcagaagcctgatatgggcagtttcggcaaggccacgtaggagaagcaactcacgctcggcgactatgaacagtacgcgaaatccgagtacggcgtgagcagctcgtattacatcgagacgagttccgcagctgcagtggacggaggaatcgaagcggtcgacacgaacaacggttcctcgcaggaatcctcagacaacgccaattcaagaaccgataccgggaccgcaggagccggaaccgagggcgccatgccgaatgacatgccgcgggacatgggcggtcagaacggcggcccggccatgaccacaggcgacttctcgttggtgggcttctccagcgacgaggcactggtgaacgcaccgaacggctcgttcaccatgaactccggcaaagcgttcgattatgatgcttccgacggaaatcctgtgctcgtctcgaagacgcttgccgacgcgaacaatctcaaggttggcagcacgttcaaactcgccaacatctccgattcgaagaagacctacacgttcaccgtggcgggcatctattcgaacacgcaggaatcgaacatgccgatgggcggccccatggcgtcgagcgcgaatgacgccgccaacgcaatctatatgtccgccgccacactcggcaagatcggtctcgacagcacgaaaaccctgagcatcaccgattcgaagggcaatacgcgtgagacctccgccgcacagttgagcttcacatacgtcttcgacggcaaggcggactacgacagattcaccgaggatgtgaggaaagcgggactctcggacgactacaccgtctcatcgatggacgtcgaacagtacgggcagtcactcgtgcccatcgacaatctttccaaattcgcaaggacgatgctcatcgtcgtgctttcagtgggtgcggttgtactggtgatcctcacgatcttcaacattcgcgagcgcaaatacgagatcggcgtgctcaccgccatcggcgtgaagaagtggaaggtggccgcacagttcgcagtcgagctgctcaccgttgtactcatcggactcatcgtcggaaccggaataggggcggcgacctccgtgccggtatcggatgcgctgctctcctcgcaggtggcttcgcaacaatcacagcaggaatcccggcgagcacagttcggacgcgatatgcaaggtgcccccggcgcagcaccggacggcaacgctcagtccgcgaaaccgaataccgacaatacccagggcgaatccgcggtaccgaacgaggggaagcagcctcaaagcggcatgccgcaaggcctgcagcacgcatcgaatgcgattaaacaggtgaatgcgacggtgagctgggcgaccatcggatggatgttgctcatcggatcggcgctcacgcttctcgcttccctcaccgcggcgatattcgtgatgcgctacgagccactgcagattctcgcagaccgttcatgaacgggaatccccacacacctaacagaatggaacatcgatgaccatgcataccgaaaccgaaacacccaccacacatagcgccatggcggacggcgagacgtccgtgccgattctgcagctcaaggatgtgagctatgcctacgccaaaggaggacgcaatgtgctctccgacatcaattacaccttccccagcgggtcggtgactgcgatcgtcggcccgtcaggcgccggcaaaaccacgctgctgtcgctcatcagcggattgaccacacccaccggcggcgaggtgctgttcgaggggcacaatctggcgaagatggaccggtactgctaccgcagccgcgacatcggcgtgatcttccagagtttcaatctgctgcccggcctcaccgtgcttgagaatatcatgctcacgatggacgcgagcggcaagagattcgacaggccgaagcgcgacattgcactcgatctgctcaagcaggtgcatttgcccgaacggtatgcaaacgagcgcatcctgcatctgtcgggtggcgaacagcagcgcgtggcaattgcccgcgcattgagcacgaacccgcaagtggtgatcgccgacgagccgaccggcaatctcgaccctgccacgcaggacgacatcatgcgcatctttattgaactcgcgcatgagcagaacaaatgcgtgatcatcgtgacgcattcaccccagattgccgaacgatccgaccgcgtattccaattgagcaagcgtgattgagatctgaaatatgcgaagaccgcacgacatgcgccgcgcggtctttgcctactccctgcggaatcgcgagaatagcagtgcgtcaattccccatgaagctgaaggtgccggcgaatgccgcacttgctaatgcaatgactgggatgagcaggcatccggcaaggaaccaatagtcgcgggcatgcacatggctcatgcgcgcatggcttcgtggtgcggtgccgccgaacccgcgcgcctgcatcgcaaccgccagggtggtggaacggcgaatcgagagcacaagcaatgcgaaggattgcgggaagaacgatgccaccgcactgtcgtcgccgagacctcgcgaacggcgggaggcggtgagcgcggtccagtcgtcctgcagcaccgagaacagtctcatgcccgccaaaccgccatatacgaaacggtccggcagatgcaggatctggctgaagccatccgccagatcggtcgcatcgatgccgagcaccgcgatgatggccggaatacctatcgcgagaatgcgcagcgcagtggccaacgcaagctcggcggatcggtcggtgatgttcacccacccccattgccaccaggtgtcgccgccggacttgccatacagcagcacggcaagggccgagccgggcgcaccgatgaagatgggccaggtggaacgcacgatgcgccacggcgtgaagccgatggccatgagcaccacgaactccaagccgagcgccacgcttgccgaaacccagtccagactggccagcaacggcagcgaggcgaggaatgctccaaacaggcggtatacgggattgattgaggcaaggaaccgcgaacggctcgccggtttggcctcctccacacgctcgttcacttggctgaccggcacaagtgtggtatccaccgcatcctggggcgatgccagacgagcggcgatggtcgcagcaacgtcgtcgccaaggccctgcggattgcgggtcggcacgagctccaccacccgtgcgcccaatgcggtgacgagctcacggtcgtgggtgacgacgacgatgctcacgccgtcggaacgcaaatcgtggatcagccgcacaatctgcatccaggtacgtctgtcctgtccgaaggtcggttcgtcgaacagcagcaccttcggtgcggaggcgagtgcggaggcgacggtgagtctgcgtttctcgccaccggacaacgtgtacgggttgacgtgcgcgtattggtcgagatggaatctcctgagcaggtccatgccccgtgcgcgcgcctgctcctcagccattcccgtgcgcagtgggccgagcatgacctcgtcgagcacgctcgaacaggcgaattggtgctcggggttctggaacacgtaggatatgcgcgaggcaagctgacgtgacgtccagtcgatgggccacaccttgtcgagttcgcctgcgagcccgtcatgggcgatgacctcaccctccaccggtttgagcaatcccgccagcgtgagcgacaacgtggatttccctgccccattcgcccccacgagtgcggtgatctgacctgggtggaagtccaggttaatgtgttcggcgatggcgttgccgtcacgtccgatgccgagctccttcgtggagagcagcacttcgggcagacctgtctgtggagcatattcgggctcatccaccgtgtggatgcgcgtgatctcgtcctctgctgtacgataccgctccggcacccagattccgagttcgttgaagtcgatgtcggtgttgtggaacacctcgtcaggtgtgccatccgccacgaccacggtgtttcggaagttcgtgcgggcgatctcgctctcctcgccgctgttgccgacctgccgggtgtcgtcggtgcgctcgagaccgagcaccaccacacggtcgatcatgtcgatccaccggtcggcgcggtgctccacaagcaccatcgtcgcatgcgtctgccggagcacgtcatccaccgcgccgaccacctgcaccacgccatcgggatcgagattggctgttggttcgtcgagcagcagcacctccgggcgcatggcgagtgcaccggcgagggcgagcctttgcatttggccgcccgacaggtgcatgaccgaacggtcgagctgtacaccggccagaccaacggcattgagggcctcatctacacgttgccatgcgagatcacgcggcacgttgagattctccggcccgaacaccacgttatcccccagtcgttggaagatcgcctgtgcatccggatcctgcagcaccagcccgaccttgccgcgcgcggcatgcacctcgatgccaccaactcggatggccccctcggtgatgccgccgtcggcgtcctccactgcaaccggaggctctccctccgccgcattgttcactcgggatgcgtcggtctgcccggtctcgtcaccgagcagaccggcagccccctcgagaatggtggatttgcctatgccggaagctccaaggagcagcacatgctcaccggcatgaatcttgagatccaggccgcgcaccgcgaaatgcttgcgcgaggcatgacggtagccccaatggtcgaattgcagggcgatgcccgtcgtgggttccacgcaggcggatttcacagtggtcataacgtgctttccggtattcctcagagttgtggtgctgagctcaatgcttggcgccgcgcacggcacggcccgatgcgaactggtcgagcgctccggttctggcgatgccaagatacaggtaccacatggccacgccggcgacgagcgcgccggaaagcacggtggtgatcaaatacacgacgccgtaggagccgcccagatcgatggcctgcaggtgggtgaagaacgaatacccccagcaacccacgccgctcaacgcgccggagagcacggtgacgccgaggttccattttttgtaggcgaagacggcgaacgcaatctcagcgaacagaccctgaaccaatgcgatgaggaaggtttcgacacctccccacatgttgcccatgagtgcctcgagcacgccggcgacgatctccgcatagagcgcggcgcccggcttgcgcacgatgattgcggcgagcggtccggcgaacagccacagaccgttgaaaataccggcgagcccgggcaccacgccttcgagcagcgaccacggtgccgctgtggcgaatgccacgaaccaatagatgagcgcggaagccacgccgatgaccgaggcgacagcgatatcgaccacacgccatttgaggaccggtttcgcttcgatgacagaagctgacatgatgtgtgcctttctcaattccctatttgaatacaggcacgggtgtagagcgacgtccgtgcgccggcattgcccggattcacgttcaatcggtcgaggttaccctctctcagccggtgctttgcaccagctcccgtgtcgatgccgagtctaatgcacaccgctgaccgacgccgcacgttccctcacaatgtgggcgcacagcctgggtgcgatgcgactaccgtcatctcattcagcgtcgcttgaacaagaggaacaattgcgattggcgcgccgtcatctccatggcgatggcgccgacgaacgttccggagcacatggccaatggcgcccggcaggaggcgagcatcaccgacgcaacgtcaccaatggccatgcgcgcacaatacgcacaaatcaacgcgcatgcgctcaatgctcccaatccggcccagacgagcacctccgtgcagatgccgagcagcagcgccggcttcgactccccgaatgcagcgcggcggcgtattccagtcgccgtacacgcaccgcaagcacaccgatgaccacgccgatgagtatggacaggtagggaatccaatgtgtcacacgccccatatacgtggcatatgggtcgtaatgcgagtcaaatcccttgtcgagggaggtcacgccagcctgccccgacccctcgcctacccccagcgtggaatacagcaggttgctcgccgccccagaccgaggccattgcctcacccagcattcgttgtacgtaccctgagatgccgcacggggcaccaagaacgtataggcaaaccgtgtatcacgcccatcattgggccatgaatagatcccagcaaccatcgcctcgccatggctcgtactcagcgtcgaaccgattgtcaatccaaaatcgcgcgccacttccgtgggcacccatatgcccgacatgtcgattgagtcagtggtggttccattcgaggcgaccagcgacaacatgcctggcgtgacctcatacgattgcaatgcgttgttcggtgtcgacaatgcagtgatctcgccgccggcacgcatggcgccagcctgcgtaattgcaccgtcggtggttcgcgtcaatcggtcgcaggcgctgccgtcgacagttccgccgatcaccgaatccacatcggccacggcacgcacccgcgtcagcgactcacactccatggccaccacagtgtaggcctcatagccgcccagcagcaccccgcccagcagcactacgaggaacagcgcgagggcatgcgccgtaccgctgccgatgttgcgtatcgcctccgagaatattgacctgagccccatgccgactctccctcgtcctccgcgggcgcatagcaagccagatctattacgcgcgcaggcgtccctcgtgtcggggtcatgcgtcgccaccagcacgatcatgccctggttcgcgaggttgccaagcacatggctcaccgaatgcgcggtcctcgtgtcgagctgagctgtgggctcgtccacgagcagcatgtcgggtctcgagcatacggcccgcgccagcatgagacgctgtgcctcgccgcccgacaattcgctgaaccgacggtctgccgcataatccaaatcgaacaacctcatggcttccaatgcctgcggttgtgtctgccgccggtccatgccctttggcgagcagcgggaacaccacgtgatcgagcgcggtgcgttgcgccacacccaccgggttctggaacacccagccggttcttgcgatgccctcgcgttccacgctgcctgcatatggtttctcccagcccgccagaatcgacagcaacgtggacttcccacaaccggacggcccgcagattgcggctgtcgttcccggttccacactgaaatcaagatgctcgaacaatagatcggtgcctggaaatctatgacccagatcatgcaccaccagtctcatcacattcacctccccacgttcacgagcagcgcagggtacccaggcgcggtccaatcagcacgcgatcgacgccctctcctccaccactcgacggctgcaccagcgacgcaccgagttcactggtgatgatgcgcaccggtacgacatggggattgtcgaacgtgccggtggcgatgcatgccgaggtcccattgatgccgaacaccgaaccgaccggcacgcgtagggtctggatcgccttgttgagcgtgagctgggtccatgccggcggcgcgttcctcagcgctcttgccttggtaaccttcggtggctgcaatccgctgcagcagttcgccgtccgtgatgtcggtggtaccgggcgccaacggggcagccacgccgaataccgtgagcgggcgcccttcatcggaaggtttgccaccgcggatcgccagtctcactagccctcccggcacggtgcccaacggcgctcccgcctgcaccgcgctgccccgagtggcgctccacccctgcaccttcaccgaatccgggggaatccacatcgtgtccgacagccgcaggttcatgtcgtcttcgccagcgccatccgaatttccggcgtccaccatgagctggcgccagccattgccggtgttccggttgtattcaccggattgcggcacgctgtcgtatccgagccgtgacagttcgtcgttgagcgagcgcacatcctcgccgcggtcgcccaccttgaggtcgcggtagagcggtgttgcggtgtgcagagcgactaccgtgcggtcgttcacctgataggcgcgagacccggagcgcagctcgccggccatccagttctcggtcacggttccggtggcattaccgggcagctgccggtcggccgcgatggtgggcaccacattcacctgttgcgtgccggaatactcctgcgagcttgcaggcgccgattcgacggtatgaggcataccgagcatcgtgggagcccgatcgggcagccagagcgcgcatgccccctgtcgtgagcgcggccgcggtgatggcggcgagcagcacccataccactgcggtactgcgaccgcgggtctgttcgcggcgtggccttgtccccttctgcttcatgtttcctcacatcctcgtcgatatggcctgatttcagccttacatggtttgtctccgtttcgcaacctgtctacacgttttgttgatgtggtttcgaatgcggcgcaccactatcctcctaagacgcgccacggcgtttctcaacaaaacacgcagattgtggcacgcatatcgggtgcttcatggtggagagacttaggatgggcatttgcttgttctgacacgtatcaaagcgttgcgatagacatctttaccaccttgggaagccgaacatcggccatagttgatgcatcgtgtttggctttccgttctgcaaaggggcatgaatgaagagaacacgcagcataccatctttgatcgccgtcatcgcatgtgtcctgagcatatcagcctgctcggggaatgtctccaagaccgacgacagcatggcgggggccgacacgggcaagttcgcaagtagtacaacagattttatcgactcaatgttgaacaatagacagtatggcgaatctcagaagaaagtgctgcgcaccgcgttgcaacatgatgggaagatcccgtatgcggcatacagcacggcgtgggaatcctataggcaatgcctaatggagcggggtacaccaagccgccgcagaaccagagcaacggagtatatttcgcacccatctgcgtttcctccgaaggcctgtctgacgcgcagagccggaaattggacgaggacatagacgaatgcaaggatctgcatgtttctgccatagacctggggcatcaaacccagctgggcaatcccgaattctacggagatccggaggtggcgctgatcgattgcctccaccgcgggaatctgatgcccaaggattacacgatcaacaagtattggctgcaattcgaggcgtatatgaacggcaccaaggcaggtagcgtgcctgacgattggttcagcttcgatttgaatgacagcgccatgctcacctgccttgcatcggacaaatccccgctgctgcagaccagattggaggcttggaagccattcgggtgactctcaaacttccctcccttactgcaacgggatctcgacggtgccgctccatccaccatcgtcggcatcatgcgagaagtcgccgcccatcgaggtgatgagcgattgcagcgagcgcaaaccgttgccaccgccggccaccgactgctcgccgataccattggcgtagcggatgcatacgtgcgatgaagacagcgagatcgagacgtggtatgggcgtgcggtctcggcatgcttgagcatgttcgtatagagctcatgacagatgaggctcaacaggccgcaaagttccgacgaatgcatgtttgcatcctgtgccgattccaacacggtctcgccggagaatccatggtcatgcagcagcctgtcacctgcggcggcctcccgccgcaacagcgccaccacattctccggctcgtcgccattctttttgaagtcgccgtcgccgcgcagttgggtgatgatgccgcgaaggtccgcgagtgcgttctgcgtgtaatcggacacacgccgccagcgttcctcgtcgggcacgctcttgtcgacggcgtgcagctgcgtctccatcgagatgagcgccaactcctgagacaatgcgtcgtgcagatatgcggccagatactggtttgcctcgagttgcctgaggcggctttcgaccatcacgctctcacgcatgcgctccatccgtcgctgctcccatgccatgtatcggccgatcgtcgacgccacggcatagatcatgcagaacgccaggcacccgtagccggtgaacgatcctggtcgaatcatcgtttctaggcaggtgtacgacatcatcagcaggcatagtgccgcggcgatgcgattggacgtcttgtagcagatcagtatcacggccaggaacatgaagtacgatgtgaactgcgcataccccgaaatggcgtattcgcctacgccattgagcagaagcagtgcgaccgaacaccagaccggtgaccagtagcagctgatggcgagcgcctgcgcaagcataagtacactgatgaaccaccattgttttggtggtgtgaacaaccagacatcgcattcgaagaccaaggagaatgccgcgatgatgaatgcgaggaatgggtgggcgatgttcttcaggcgtttctgcatggtgcaaccagatgcatcagcaccaacccaacgcatgcatccaagcagggcactcccttgtggccattgcggccattgtggtcgttgtggtcgctaggagaacattgacccgggaagaccagaccatgtcggcgcacaccggtgacccgacctgcgtcgaggctgcgaacaacaccgaaaccaccgctgatacaaccgacatggcgtctcctctcatttgccgctacagggcatggacttatgctctgcccagtttatcaaggagcagcgcctcggcaacgacgtccttcctcaaccctgacacgctcacggattcgttggggctgtgcgcgttcgaaatcgggtcctccgggccggtgaccaacacctgcgcgtcggggaaaatcttctgcagttcgggaatgaacgggatggagccaccctcccccttgttcaccgggtcgatgccgaaagcctccttgagcgatgtgagcgcgtcctgcgtggcctcgcagtctgggttcatggcccagcccataccggcttccaacggttcgacgtgcacctcggcgccgaagggcgcgttcttctcgaagaagtccaccatcgcgtccatggccacgtgcgggtcctgttgcggcgccacgcgcaggctcacccggaatgtggtttcggggctgatcacattgaatgagtccttgacggggtgggcgtcgaagccgatcaccgtggcgctcggcttcgtccacaaccgtgacgccagcgaaccggtgcccaccaacgtgaacgagtcgaccacgccggcggccgcacgcatgtcggcctcatccagatcgcgctgcaggccgccgatcggctcgccctccataagccccgggattgccagttcgcccttctcgtcatacatcttcgcgatgagcatcgaggccagtgtgttcgcgtcgagcaccgggcctccgtactgtcccgaatgcaccggatgcccgagcacctttacatgcacgtcgcaggtggcgttgccacgcaagctcgtggtgagcgacggcacatccggcgcccagttgccagaatcggcgacgatgatcacatctgagtcgaattcgtcgtgatgtgcttcgatgaacgggatgaaactcgccgaacccatctcctcctcaccttcgatgaacaccttgatgttcacgccaagctggtcgcccagagccctgagcgccccgtagtggatcgcgatgccaccagcgtcatcgcaggcgccgcggccataaagcctgtcacccttcaatgtggcctcaaagggtgcggtatcccattccttctcgtcgggcacaggctgcacgtcatggtgggcgtacaacagcacggtcggggcgttcggattgacttccagagagccgatcacctcccatgcgctcggattgccgtccttgtcacgcgcctgcacagccttggcgtccacgcccacctcgcgaagcttgttcgccacatattccgccgatttgcgcatatgctccccattgatgccatgcgcggagatgggacgcaatgcgatgcggtcctccaccacgcccagaatctgcggccaatcggcgtccacgcgtgcgcgaatctgatctgctgtcaaaatcatgtccgtcctttccgaggattccaaattgtgtgaaatccggttccgcaacgccattgtaatcggctttccccacgatttcgcgtcgagagttgcccgtaccctagcagattatggctttgttcaagaagaaagagacggaaagcaagcaggacgtggctcaggcccctgcggagccgaccgtgggcaagggacgccccacccccaagcgcaaggatgccgaggcaaggaatctgcgcccattggttcccgagaacaccaaggagcagcgcaagctcgccaagcagaagctgcgcgagcgtgaaaaccgcgagtacgaggcgatgcgcaccggcgacctcaacaacatgccgaaggccgaacgcctgccatggcgcatatacacccgcgactacatcgatgcgcgtttcaacatcggcgaatacttcattcccgtcgcattggtcatgctcgtcgcctcggtcatcttcaccgtgatcttcccgtcaccgctcgtgtcgattatcatcatgacattgctatacctgtacctgttcgccatcgtcatcgacgaggtggtgatgtggcgcaagctcaagaaactgctcatcgccaagtacggcgagcagtcggtggcacgcggcatgcgcaccggatcctatgcgtggagccgttccatccagttccgccgctggcgcctgcccaaaccacgctatgccaagcgcgggcatttcccggagtagtcgcaccctatccgagacatacaaggaggggaacgcaatgcgttcccctccttcattacgaccagccttgcacatgcccacggaaagtgttttccaaagagatcccccgaagcacctgttgcactcttgtggcatgcgggctgggcgagtaatctgtatgcagcgtgcatgacggccaatgtcgccgtgcatgggaacaaacgaaacaggaacgaagcgtatgacgagtgaacattacgacgtggtaattatcggcgcaggccccggcggctacacagtggcgctgcgctcggcggaactgggcaaatcagtgctgttggtggaacgcgacgatgtggtgggtggcacatgcctcaaccgcgggtgcattccgtcgaaggcactcatcacggcaacgcgcaccattgacacgatacatcgcggcgaacagatcggcatagactgcgagctgcaggaaatcgacttcggcaaactgcgtgcgttccgcgatggcacggtctcgacgatgcgcgacggactgctcgcgctgctcaccttccgcggcgttcatatggtgcagggcatcgcctcggttgtagaggacggccatgtccatgtgagaccggcacagggcgggcaaacgatccgcatccgcactgcagacggcgatttcaaggacggtgggcaatctctcgacgtcaccgcaggcgatgtggtgatcgccaccggctcacggccgaaaccgcttgatgtggcgccgttcaatcatgtgctcatcgactcgacgagagcactggcactcaactccttcccacacagcgccgtggtgattggttcgggggccacggcgcttgaattcgcgtcgatgtggaattccgcaggagcagacgtcacgctcatcatgcgcggcgacatcgtgctctcccgctccgacaggcgggctgcgaagatactgatgcgcgaactgaagcgacagggcatcacgatcgtgacgaacgctgccatcacggcggtcgacactggggagaatctgggtgtcaccgtgcattacacggacgcagacggcaacgggcaggaggtattcgccgagtgggcgctcgcagccatcgggcgtgtgccgaataccgacggcgcatggttcgcgaaggcatcgattgagctcgatgagaacggtttggtgaaaacggatgcctacggccgcaccagccgggaacatgtgtgggcgttgggcgacatcaccccagggcaccaactggcacaccgtgcatatcaacaaggctatgtggtggccgaaacgattgccggactcgatccctccccggtggacgaatacacgatcccaaccgttgtgttctcgaacccggaattcgcctccgtcggctacacgctgcgcgaagccaaggccgacaccgagctcgtcgacgtaaccgaaacgctcatcccggtcatgtcgaacgcgcgcatgctgatgagcggggcatccggttcagtgtcggtggtgagcgggaagaagtccgcagatcaatcggatgacgttcatgtgctcggcgtgcatatcgtctcccccgacgccagcgatctgatcgccgaggcacagcagatcataggcaaccatgttccattgagcgctgccgcgcgcaacattcacccgcacccgaccttcagcgagatgctcggggaaacgctgctcaaagccgatggccgaccgttgcacacccgctgacccctcgccggatacgcaaccgtcacattgggacagcgcatgctgatacagtaaatacattgcccgtattcgtgttgaaacaagctagagagggatacatggcgcagcaagagaagtctgagaagccaaagaaacgcggaatgttcgagcagatcgtcacgatctacaagttcacggcagccgaggacaaggcgctgccatggatcaccggcgcagtgttcgccgccccgatcgtcgtgggcatcatctgcggcatcgtgttccattggggttgggtctcgtggatcacgctgatgattctcgccgtgatgattggattgctgctgttcacgatcgtgctcacccgccgtgccgacaatgtcgggtacaagcagatggaaggcaagtccggtgccgcgatcagcattctcggcaacatgaagcgcgccggattcgatttcccgcaggaaccggtgtgggtcgacccgcgtacccgtgacgcagtgtggcgcggcaccgggtatcagggcatctacctgatcggcgaaggcaattacggtcgcgtgatgcaggcgatggaccgccaggaaaagcagatcaaaggcgtgactgcgggttcgcatattcccgtctaccgcatctgcgtgggagacggtcccaagcaggttcgtctcaaggatctgcgcaatacggtgctcaagaagaagacgtacgtgccgaacaactacaccaatccaatcatgcgcaagcttcatccgcgccatcgtttcgcactctccaaaccgcagctcatcacactgaacgaccgcttgcatacactgcagcgccgtagcggcatgggcattcccaagggcatggacccgatgaagacgcacaaggtgagccgtcgcgcgatacgcggcaggtgagccattcacattcgacgatcccggccatctggccgggatttctttttgggccttcggctccgtgaggcatgcgaatccgaaaaccggcgagccccgagagtggcacggatttggaatgtgacacggaacagcacgtgtccactatttgaaaaccattggaaacacaacgttttcgaagtgttagtccacgtatgaaacatgttgttaactcaaattacgagtgggcgaaatgctagtccctatgcttgtggaacgtaagcaacatcgtgaaaggagcggtcccgtgaccccactcaaaaccaaggcagacgccgaagctctcgtcaatcaggaaggcatcgaatatgtttccgtgcgcttcaccgatctgattggcgttcagcagcacttcacggttcctgccagcgaattcctcaaggacgcgttcgatgagggcatgcccttcgatggctcctccatcgaaggtttccaggccatcaacgaatccgatatgaagctcgttccggatatcgagaccgccttcgtcgacccgttccgcaagcacaagacgctcgacgtcgccttctcgattgtcgacccgctcaccgacgagccttactcccgtgatccccgccaggtcgccgcgaaggccgaggcatacctcaagtccaccggcgtcgcggacacggcatcgttcgctcccgaggccgagttcttcatcttcgacaaggtgcgcttcggcaacgacatgcgcggctccttctacgaggtcgactccatcgaggcaccgtggaattccggactggacgtcgaggaagacggcactccgaacatcggcttcaagaaccgtgtcaagcgcggttacttcccggttccaccggccgaccacacccaggatctgcgtgacgacatggtcgccaacctgcagaaggtcggcctcatcctcgaacgtgcacaccatgaagtcgccggcgcaggccagcaggagatcaactaccgcttcaactccctgcagcatgcaggcgatgacctcatgaagtacaagtacgtcatccacgagaccgccgctctcgcaggcaaggcagccaccttcatgcccaagccgatcgcaggcgacaacggcaccggcatgcactgccaccagtccctgtggaaggacggcaagccgctgttctacgatgagaagaactatggtggcctctccgacatggcccgttggtacattggcgggctgatcaagcactcctcgtcggtgctcgccttcaccaacccgtcgctgaactcctaccaccgtctggttccgggcttcgaggcgccggttaatctggtctactccgcccgcaaccgttccgccgcgatccgcatcccgctcgcaggcacctcgcctgccgccaagcgcatcgagttccgagcgccggatccgtcgtgcaacccgttcctcgccttctccgcacagctcatggcaggccttgatggcattctcaaccacatcgagccgccggagccggtcgacaaggatctctacgagcttcctccggaggagcatgccggcatcaagcaggtgccgtcctcgctcgccgaggccctcgatgcgctcgaagaggaccatgacttcctgacggccggtgacgtgttcaccgaggatctcatcgagacgtggatcgacctgaagcgcggcgagatcgatcaggctcgcctgcagcctactccgcttgagtacgagctctacttccacatctgattcgccgaatactggcatttccaaggtgggtgcgcatacgtgcacccaccttttccgttatgcggacgggcatgccctgcaaattcggggcttgtgcctatgatcgatgtagacacgggggcttgcttggcaggctgagatgaagcgaacgcttcgaccgcatgaacgtgaaccggataatgccggcgcacggacgtcgtatttcccgtgtctttcgatatctcagaaaggcacaatatgatctacccatcacaagcaagctcgcgcaagtggcgtgttctcgacatcaccgtcacctcggtgatcgccgtcgcatccggtgtggtgttctggatgtgggactgggtgtgcatggcaccactcacattattcgagaacatcacacccggcttcgagggactgctcaatggattctggctgttcgcaggtcccttagccgcggtcatcgtgcgcaagccgggtgccgcactctatgccgaaacggttgcggcgttcctcgagctcacgctcggcaaccaatggggcgtgggaggctccctcatcgtaggtctgatgcaggggctcggcgccgaactggctttcgcgctcttcgcatataaggtgtggaccaatcttgtggtgctgctgtccggggcattgtccggagcgatgtgcggcgtctactactggttcacgaacccggggtggggaatgatgcgggtctccatctatttgggtacctcggtggtgggcggtgtgatcgcagccgctgcgtgcatcgcgctgtcgcgtgccatcgcccgcaccggagccttggctcagttcgctcactggcgtgttcgtgacagtgaggcgaagcgtgcctgattcgcacgccatacggtggctctgccgccaatgaccatgtctgtgcaatctctggcgcgttgggaggttatgcaatatagtggggcgttgatcgtgacaccgatttctttgaagttgagaaaggcatggcatgactgatcagacgcagattatcgaaaccgccgtcattgagcggctcagccacgtgatcgaccctgagcttggccgctcggtcaccgatctgggtatgatctgcggcgtcgatgttcgccccacaggcctggattccttcaatgtgcgggtcaatgtggagctcaccgtgcctggctgcccgctgtctgccgagatcagcaggcagatcgaggcggccgtgaccagttatgccgaggcgcagctcaccgccgagatcgtcgtcggcgcgatggatgaggagaaactcaagtcgctggtgaacgatctgaaagccgcccgtcgtgagaacccgttcagcaaaccgggtacgaaaacgcgcatcttcgccatcgcctcaggcaagggtggcgtgggaaagtcttccatctccgccaatcttgcggccacgttcgccgcactcggctacgacaccgcggccatcgacgccgatatctacggcttctcgctcccccgcctcttcggcgtccacgaccagcccacgaatctgaacgggatgctgatgccggtgaccgcgtggggcgtcaaactcatgtcgattggcatgttcgccggttccgaccgtgccattctatggcgaggcccccgtctgcagcgttcgctcgaacagtttctggccgatgtgtggtggggcgaacccgatgtgctgattcttgatctcgcccccggcaccggcgacatggcgatttcggtggcgcaggcattgccgaacgccgagctcgttgtggtcacgaccccacagccctccgcgtcggacatcgccgtgcgttccggcctggtcgcacttcaggtgccgatgcgggtgcgtggcgtggtggagaacatgagctatttcgagcatgcaggcgaacggatcgacatattcggcacgggaggcggagctcgtgtgagttcccagttgaccgatgcgctgcactatgaggtgccgctcatggcgcaattgccgctcgacccgcgtatccgtgagatcggcgaaagcgagggacgtccggccgtgctcaatgatgacggcacgctccgcgacgacgacttcggtcgtaccttcggacatctggccaagagtcttctggcatagcaaactggcatgtgggcagcgtgcaattgcagcgctgcccacatgccatcgccttgtccggacgccgaatcattgcacgtcgccggtggcgagcaaagtgtcgaactgttgctcgtcgatgatcgggatgcccagttcctcggccttcgtggccttcgaaccgggattggctccgacgaccacccaatccgtcttcctgctcaccgatccggaggccttgccgccacggcgttcgatggcctccttagccgattcgcgggagaaatgctcaagggtgccggtgaccaccacgctcttgccttccaacgtctgaggaagaccctcgtcatgcgtgctcatgcccacaccggcggctttccacgcctccagcacacggccgcgccaattgcccggcatgcgagcctcctcgaagaatgtcgcaatggaatcggcgatctccgcgcctatgccgtcgatctgttcgagttcctcggcactggcgtcggccagcgcatcgagtgtcttaaagtgcttggccagcgtgaatgcggtcggtgggcccacatggcgaatggagagcgctacgaggacgcggctcagatcggtatgcttggctttctcgatctcatcgagcatcttcctggtgttctcggtgggttcctcgatgcgcggccgcccattcctgccatggcccacaatcacggcatccggtttgacctcgtattcggggttgccttcggagtccttcaccgtcttgcgattcgcgtccttcttcagcggggcatccttgaccccggaccagaaagccggctccctatgccacaggccggaaccgccgagacgatggcgcaccttcctctccttgccatgcgaatccacgtgcctgcgcacttcgatgatctgcgcttcacgccacacatagacatcccggaggtcgcttgcttcgaggtcgaacaaattcgcttcactggtgagtacgggctcctggatgggcggaagttccagcccgctcggagccagatacggtgccggctcctcgcctggttccaccacgatctcacgcacgccgggggcgtaggcttccaccgagtccggcctgttgtcttcggggttcgtcagcgccaccgcgctttggtcacccagatgctcaatgtcgaatgccttgcgggccgccagattgatcacacgttcggcgagctgggccgggcagctttccgaattcgggcatcgcaggtccttgtctccctccttctcataccgcaacacggtgtcacaggatgggcatcgtgtaggcatgacgaactcgcgtaggtcctgttcatgcccttcgcgtttggcgattactgggccgaccagttcggggatcacatcgccggccttgcgcactaccaccgtatcgccgatgagaatgcctttgcgtttgacctcgtatgcattgtgcagcgtggtgcgcgacaccgtggatccggccacatacaccgggttcagtatggccaccggtgtgactctgcccgtgcgcccgacctgcaccacaatattgaggagcttggtgttgacctcctcgggcgggtatttgtaggcgatggcccaacgcggcgcgcgtgaggtgctgcccagtctgcgttgcaacgcgaggtcgtccactttgaccacaatgccgtcgagcgcatgctcgatgtcaccccggtgctcgccgtagtattcgatcatgtcgagaatctggtcgaagtcggtgacctcgcggttatggggcgaaatcggcaccccccatttgcggtacatcgtgtaggcatccgactggttcctcacctcgtcggccacatccaccggcttgcccgacccccataccagttcgccgatgccatgtgcatagaaactcagatgccgctgcgcggtgatgcgcggatccttctggcgtagcgatcccgcggccgcattgcgtggattggcgaacggtggtctgcccgcatcttcgttcgcctcgttgagcttgtgaaaatcatcccaccgcatgaacacctcgccgcgaatctccaccatatcgggaatatcgccctccgggccatccagattggtggggatggagtgtatcgtgcgcacattcatcgtgatgtcttcgccagtgaccccatcaccacgggtgagtccctgcgtcagaactccgttgcggtagatgagattcagagccagaccgtctatcttcacctcgcaggtcatgggcaacagcttgtcttccggccattcgaggtccttgcgcacgccatcgtaccaggcacgcagttcctcgaaggagaacacatcatcgaggctcatcatctgggaggggtgccgcaccgccgtgaagtcgttcgagaatgtgccacctacccgatgggtcggtgactgaggcgtgtcaagctgggggaactccgactccagtcgtttgaggcaattcatgcgcgcatcgtacgctgcatcggaggaaagcggggcgtccttgacgtaataggccacctgatcgccctccacccaagcactcagacgtgaccacagccgcaccgcctgctctacattgagcttcgacacgtcgagatcatcaagttccatcgcatcactgtcgatgtcacgcaatgagtcaatccacggatccgaaccaatcggatacctgtcgagctgctcgtctgcaatcaatgcatcttccataaccggattcctccaaatcctacccaatccgaaacgccacggtcttggcccattggtcaatcctacgcatctacgcaccagagagggtgccggacgcgccgtataccatcgtcctacgcattcagcgagcgcaggaactgcatgcctcccgggcccagattacctccctgcagcgcataccagctcacgttgagtgcctgtgccacggggaagatcttctcgttggtggcggtgaaggcagcgtcgcgaataatctgcgcgcattccacctgcggccacaccggcacgtcatgtcgcatcaggactccgacggcctgggcaccggtctgtgcgatctgttcgccctgtgccatggcgaggttgcggaatcgttcgagcctggcacgttgcgcgggtgcgaggttctgggtgagcgacgtggcgaggttgccggccgccactgcgacggcggtgtcgcctttcatccagctggcgcagacgtagtagtagtatgcgttggcggcatccaccgggtcgcaggctacgcgcagcgcgttcagtgcggctgctcgcaccgagttccaatcctcagagacgcatagtcgtatggcctgttggatgtgtacgccagcggtggcgggcgcgtatctcaccaaggtattgaggtgggccatcgcctcctcgcccctgtcatagcggaacagtacttcgcccatgtcgagatgagcttggaacagcgcatcgggcacgagggcgatgcgctcgtccggcatggcgaacagccggttgtacaccacccggtcggtgtaggaggtgaagtagcgcggcaccacgccgtccgattcgaacatctcgtcgagttcgccgatcacgcgttccatgttcgcgattgccccctcctcatcaccggagaacaccatctcctgtgatttacggcgtgcgtcggcgagtgctctctccacggtgctggtgatctgcggtatgggggtgccgtcgatgattgcggtggtgatctcggtggcgtggttgcgcagttcgggatctgcgcactgctcgatcaggcccattgcataggtggccttccggtcggcacgtaggccgtcgttcttcgcagtgtccgcaatgagttcgagggtgccccggaacatttcctctcgcgagatcgacaggtcgcgtacattgtgtgcgcccagtgatcgcgccactgttgcatcgagaggcctgtcgcgtcgttccggaatcgtgtaggccgcgtcgccggtgaagcgtgtgtcgtccatgctgaagcctggttcgaccggtcggaatccttcggtgccatcgtaatcgtattgcgcgccgaacgcgtcgtatacggcgaacgggtcggcacagctgttggcgtgcatgtagtcgatgaattcatcacgcgtgaatgtgacggtgagcaggtgttttatggaggggttgctgttgcgcaatcggtcgaattcctcatccacgttcaggatggattgcaccgtgtcgtcctccgattcggcatgatgcgtcgtcgtatcatcggacgacgtggattcgtcgtgctcgagcaggtcgcgcaattcgcggtcgaagtcggcatcggtctgcatggcctgcgtctgaaccccatcatgctcatcgtcgccgactcccgaggtttcttccgagccggagaacagggcgctgccgcgttcgccgaatcttccctggccggcgtgcgtggtgaaatcctcaagattcgtcagatcggagatttgcgtcatcgcgctgtccatgagcgtcttgatggcattgtcgcgttcgtagacggcctcctccagcccgagggaatccatgcgcaacgagacgcgtctgatctgctcgctggcaccgaatgcgagggaggcgaagatgagcccgatctgcagattgtattccgcgctgatccgtgaacgctcggcctcatcgagttcggccatggcgccggatcgcatgttgatgagctcgtcgggcatgagcgtgcggcttgccgaggtgaaggcgaatgccacctcaccttgttgcaggttcgaacggaaatccgtgtcgaatctgaaaggaagccatagggcgttgactgcatttgcaagggcgtgccggtatatccattcgctgccgacgagatgccgtacatcaacgccaacgccggcctgtgaggcgtcgagcgacgcggacagcgacatgcccctgccgaaatgcaggtaatcgtctacacggaaacattcggggtcgtcgagaatatgcacaggatgggtcggcggcagggcggacagcgacgggttgcgcaacagacgacggtcgatgcgggcgacctgcttgaacgtcacggtatcttcgatcggctgttcgctgtgggcggcattgtaatcgagccacttgtcgatcagcaggaaccggttgaccgccccctcgagcttgaggctggtaagcatcgcatcatatggcatgcgcttctcccatacgaggaaacgcgcatgggagacgggcgattcaatcatatacagcggttcactgccatggtctgcctccaattcggacaggtcacccatgacacctatgcgtctcatcgtgtcggcgaagtactcctcgagaccgctcacccgcatgcggtgcgcacgtgccgtgtccgtctgtgacacgctggtgcgaatggctgcgagcggtgagaatcgacggaaattcgaaatgatgttgccggccccatacccctgcaggccgccattgaccgacactgcaaggtagagatggaagaagcacacggccatgagatcgcggtattcgagatccgtgcgaaggcgcgcaggcaattcggcacgggcgttttcgatcgtataccgattcgccgatttgaggaagcgagcgagccagaccatgcgtccgttgccatcacgccccctgatatcgccgacaagtgcccgtgcggatccttccacggtggcgatgtgtgccggtttcgtcccgccgaagcgggaatcgtcatcggtcgtgagtgaatcggtgacgtcaagctctaaatccggttcgcgtgcatcgaggttcgcatacaggtcgccggtcatatacacggcgccggtgtcatcggccatcgccagcgtgcagaaacggtcatgcgaggtgaaatagccgagggcgaatctgcgcaggccgggcatctgcacccaaccgacacgctcgaatggcagtcccgttccagccaccgagaacgaccggcggcgcatcaacggattaagcacgatcgtctccgctgacggcatcttgacgccaagtagcggattcgtcggagtcggcgtgaacatgttgtgcgtgggcaatgcgccggcgaacatgctctgcgccgtcgactccacctgacgcgcatatctggccgcattgacacccaggttcctcagccaccgcgccggcttgcgtggctgtgggtcggaagtgtttgaattcgtgcctgtcatgtgttccaatctacacgtcaaggcgcaatatgtctgccgattacccgcacaaggtcacggcagttactcgcatgccgttagaatgacgcatgtgaacacacctgcacgccggacccatccgttcatcgccgcgctcgtcgccgcaaccgtcattgtgctcgtggaatgcctcgtattcaatttcgcatgcctgcgctcacgctccgcgaggcctgcagacgcctcacaatcgttgatcgaacaggggtcgaacagcgccgccgaccctcaggtgacactcggcccgggtctcgcaatccatggcgatggcctgctgcaggtcaccgacgcaaccaaggcatatattgatgcgcctacgaatggctcatcaccctacgcgcaggtgctcatgacctcgctgaatgacattgccctcgccagaacgaccatgacccaagtccaacgtgacgagctctaccgcgagcttgtgcatgtgcggcttgacggaggccgcatgcagaccgttgccgtcgatgcccctcgctccacctacctgccctaccaggattccgaaacccggcatgcgcagtctaatggtgaccacacggtgcgcctgtggattgaggaggcaaccgattccctcataccgattgtggggcttgacgccaacgcacgcgtaccgttcagctggaactgggcgcaggtgctgctcatggccgcgtttgccgcattgctcatcgcattctcgcccagaagccgcctgtggctcattccactcgacaccagttcgcgattgcaacgcggcgcattcaccattggggcgctggctctcgccggctatacggctgtccagatctactggcagatcgccggggccgcaccgatggcctatcacattccgggccgatactcctacgactacgaccaatacgaccatgtcgcacaggcccttatgaacggccacgcatggctcgaccttcccgtgccggaacagttcgcccaactgcgcaatccctacgacacggctgcgcgtgaccgtctgctcgagcagggcgtgacgcacatctactgggattacgcatatcacgatggccattggtattcctatttcggtgtgctgcctgcgctgttgctcttcctgccctatcgtgccatcacctcgctgttcgttcccggcggcctcatgttgccgaatgcgagcgccgacctgctgctcatgttcggtgccgccgtctttggctgtttgctggtgatccgcctgctcaaacgcatgccggtgcaggtgagcgtggccacctgcgcgctctcctgtctggcgttcgtgctcggttcgaacctgctgtatttctggcatcgcacgaatttctattcgattcccttcgcctccggcctgttcctgaccttcctgggaatgtggctttggcttggcgccccggtcgcgcgaaaacgcacatgcacgttgggccgttccgattccgcggatgccgcctcattgagtcttctgcatgtggcattaggcgcgctgtgcatcgccgccaccatcggctgtcgtcccaccttcgcattgacggcattgcttgccattgccctgttcttcccgcaggtgcgcgcggtgttcagcgcatccacatggcgggaacgcgccactcgcattcaggcgttgcgtttcctgtgcgcgctcatcatacccgccatgctcatcgtggttccggtgattgcctataacgctatgcgtttcggctcgttcaccgatttcggcaacgcttaccagatcactgtggcgaatatgaccgacttccacacaccgctcccgcagatgccgcgcgcattgtgctgctacctgtttctgccgctcacctttggcaatgacttcccatggcttgagcttacgcccgcgccgacgcccatctggttcttcaccgagacgacgcccgctggcctgttcgtgctgatgccactcgccctgttggccttcgccgtcccgttcatgagacgcccgctcggcagactgtatgccacgctgacatccatgctcgccctgtccatggtgttgctcgtgttcgatgcctatgtgggtgggttcgcgtggcggtatctggcggatttctcctggctcgtcatgctgtgcgcattggcggtgatggcatggcttgtggaacggcatcccgcatggcgtgtggtgttcgtcatcgtgctggtgtatgccatcatgctcgcattggcctccatgttcgtcatcggtcgtgatgacgccatgatcaacatcatgccctcgagattcgccgacgtgcgttcatggttcacgttgctgccgtgaggtggcatgcggacgccctccgctgttcgttctgcgtataggcacgcaagcgcacatttgcagactacaatgttcggcatgggattgctcacatcgctgttcaaaacgaccagacccgtaacaccgccgcaaaaggtcgggttcggtttcgaccacgccgtatacgcatatgacgcccagacatacggcgtgcgcgacatctcactcgatctgtcatgttcaaatggcaacacggcgatcatagggctcaacggagcgggcaaatccacactcatcgatctcatgaacggcacactcactccgagttccgggaaggtcaccgtcgaggccgatggcaagagctacgatgcgtcgcatggcggccgggcgcagatccaacgtattgtgggcaccgtgcagcgtgaggcggatttgtaccgattgcggcacaatgtgagcatcgagcaatccatcgatgagctgctcaggaaataccggctcaccaccgtacagcgtcttgcgatcgccggtgacgcactcgcgaagttctcgttggatacgaacatgcgcaccccgctcgacgaactcgatggcgagcagttgcacctgttcgccatcgcccgcgcatatgccgccaatccaggtgtgctgctcgcggatgagcctatgcgcggactcgatgagatcagctcacggcatgtcgcgcaccgtctgttcacctgtggcaagccggtcgtcttcgccacgcataatgtcgatctcattcgcaatgacgaattcaacatcacgcgtgtcattgtgatggacgagggcgagattgcattcgacggcgaaccggcgagtgcatcggcatactatgcacagctcatccgcagcaaataccgtcagatctcctcgacacagtgacgtacggcactgagcaccagacgcacatgcgcgtcgaacagatccggtaccggcagcagtgatatcgccaaatacccattggcttccatgtcgaagaaatagccgggctggccggacgtggcattgtcgcgaatcatcgtcgtcaccagctcgttctcgtcgatgaacgaggggaagcgcagcagcacgttccatcccccttcggcacggagcacgctcaccacgcccaggtcgtccgcatcgagcagccggtgcagcgattccagattccgtgagatgcgctcctgcacgcggtcatgctgactgtcgagttcggcaatcatgtcgtccatgcgttcggcgatgagctcgctcatcggcaggaagtcatcggcgatcacatcgagccggcgcatcgcttcccgaacatcgtcgtcgggaccgctgacctcgatccaacccaccttggcgtgcggcgcggcgagacgcttcgaaaaaccatcaagcgcgaacgtgagcacacggcgctcgcccgcgaatctcctattgccctcgaatggctccaacgcatagtcgaagaacacttcgtctgcaatgagtgcgatgccgaactcacggcacagttcgatgagatgctcccgctcgctgggtttgacgtattggccggtcggattattcggattgatcacaataagcgcacggatgtgccggcctgcttgcccgtcccgttccagtatggtccgcaatgccgcgatgtccatgtaccaggaaccgtcgaattgcaactggtattccaccgtcttcactccgcacagccgtgcgatcgattcgatgagcgggtatcccggtttcggcgcgagcaccgcctcccccggatcacatagcaacatcatgagccatgcataggcctgcgatgtggaactgagcagatacagtcgctccggatccgggcatcctattgccctggcaaggcgacgccgtgcctccatctgaccacgtggctgtgcccgatacacctgcgggagcaattgcggcgcaaggccgtgcgccgtgggattcgagtcattgagtttgtcgaggtccaccccacgagccttggcctctgcttcgcatgcggcgattggattcggctggctcacatcgattctgctggaaaaacgcacggcataatactactcccagcgtcgtccataacagggcgaatacggctggaggcaccatggaatcccatggcgcctcgagtcttgcatgaatgtaatgcgacctacttggccgactgctggttggcgtagtaggcggcacccacgatgcccgcctcgttatgcagcttggcggcgacaatcggggtcttgatgtcgatgtacggcaggaacttctcggagacgcggctcacaccaccgccgaccacgaacaactcggggctgaagtacagctccatgagaccgtagtacttggtgaggcgcttggcccacttcctgtagcccatgtcgagtttctcacggaccgaggatgccgcatacttctccgcatcgcccttgcccttcggcagttggatgtggccgagctcggtgttggggatgagcacgccatcgtagatcagggcggtaccgatgccggtgccgagggtggtggcgatgacaagcccatcctggcccgccgccgcaccgaacgcctgttccgccagaccggccgcgtccgcgtcgttgaccacggtgacaggacggccgcatgcctcggagaacacctcggtcacgtccacaccaatccacgactgatcgaggttcgccatgaagtcgagcttcttacccggcttgatcggggccgggaacgcaattcccaccggtacgtcctcgggcacttcgaaatgctcgagctgctggcgcacaatgtctcccacagccttgggagtggaatgctctggagtgaggatcttcaggcggggttcggcgaattcgcccttctccagattcaccggagcggccttgatgcccgagccaccgatgtcaacgccgaatgcttgtgcagtgtcaatcattgcaatctcccttgccgttcgaatccgaggcgtgcactcgttgcatgcctcataccccatattgtggcgtatttgtcggacatgaaaacgctggatagcttggttttccttatatggtacgcaattggcatgcactgggaagcaatcgtttgccgttctggcgattcattccgaactcatactaatacatcgcattaacaaataggcgtccgatctgggccgcgtcccatccgatatcgcccatattgtggacaatgggcaggcaaatccgtgcggtggactatacataggtagtgcaatttcagggaaggtgaaactccttactggcggtagcgcaacgggcccgtgcccgcatgcggagcccgcaacccgcgcaagcggtggatctggtgcgagtccagggccaacggttatagtccggatgaaagaaatgagctcgcatgagtgttttttcacacccagattcgatttcacccaaccaggtctccggcagccactccactggggcggcagaccgcggacgctggtccacgcagcgcatcgccatgtatgcgttgttcgtcgcacttgccatggcggtcagtttcatcgagattccgttgatgcctgccgcaccttggctcaaatacgatccatcgggcatcgtctgcattctcgcaggcttcgcattcggcccctcgggtgcggtcatagtcagcgtgctcgggttcgtgcctcatctgttcgtcaacccgctgggcgcagtgatggcgattctcgtggcactcgggtattcattgccggtcgccttcatctaccgcaggcgttccacacgcacaggcgcactcaccggcatcctcctcggcgccgccgtcgcactcgcggcggccatcgtaggcaatctgttcatcaccccgctctacgcgcacatgagcatgcagcaagtcgcctcgatgatcgtgccgattctgctgccgttcaatctgctcaaattcgcaatcaacggcgtcgtgagcttcctgtgctatcgcccggtctgcaagctgatcgcccgatgaacgcctcgggattccagatcgagctgcggcatgtcggattctcctatgacggcggtgagacatgggcgctcgacgatgtgaaccttggcattcgcgccggcgaacgcgtgtgcatcgtcggtgcgaacgggtcggggaaatccacattgttacgtgtgatggccggactcagcgcgcccgacacaggttccgtgacgctcttggggcacacggtgttcaccgacgaaggtggcgccgacgccgatgcgtacgcatgtgcacgacgtggcatcggcgcggtgttccagaatcccgaggatcagatcgtcacgacggtgaccgccgacgatgtggcattcggcccggagaacctcgatgtacccgccaacatgatcggcgcaagggtgcatgcctcactttcctgtgtcgacatgctcacagcatggggggccgaccccacacatatgagcggtggcgagcaacaacgcatcgccatcgccggcatgctcgccatacacagccgtctgctagtgctcgatgaacccaccgccatgctcgacccgcaggcgcgcgccgaggtgctggcgctactcgatcgcatccaggcatcggggacgaccttggtgattgtctcgcatctgcccgaggaactacggcatgccgatcgcatcgtgcatatcgagcacggcagaatcaccggtgaggattgcgcacagcacatgccgcaacacgaccatcattcccccagtgtgaccacgttcgcccagctcgataccctggcccgacatgtcaacaccgagcatgccggaataatcggggcggcaccaaccgctgtggtgttcgatgacgtatcgttccgctatgagcgggaatcggcggatgtgctcagccatatgaatctacggattccacgcggatgcctgacggccatcatgggtccgaacggatccgggaagaccactttcgcgcgtctgctgtgcgcgctcgacaaaccgcgcggcggccgaatcgtggtggagggcatcgacgtgacgcaagcgagacgacgcgagcgcagacgcttgcgtcgagtgctcggatttgtgatgcagcatcccgaacgccagctatttgccgaaacggtggccgacgatgtggcgttcggtccaaccaaccagggtttggatgcggcacaggtgcgtgaacgcgtcgattgggctttggacctcgtcggcgtgtctgacctacgcggcaggaatccgttcgaactgtcaggcggccagcagaggctggtcgccatcgccggaatcatcgcctgcgatccgtcggtgctggtgctggacgaaccatgtgcagggctcgacacctcggcgagcagacacatcgagcgcctgatggagaatcttcgccacagaggggtcaccgtcattctcatttgccatgaccccgatcaggtggaccgtttggccgatcaggttatcctgttcggcaatgagcaacagggacgggctcacgcagatagcggcggcgaggtccagcgtgaggtactctcccccaccgacacgggttactcctgggtgtccggcctcgacccacgcgtgaagatcgtatgcatcctcacggtgatgtgtgcggctttcgccatgaacacctgggcccagttggctgtgggtgtgctgctgacggctgctctctggggcgccagtcgtgtcggcttcaccaggctattgcgttcggtgcgtggcttccttgtcctgttcgcggtcatgggtgccctcaacatcggtgtcgttcataccggtgatgtgttggtaaggatcggtcccctgccgatcacgaccggcggcgtgtccgtcgccatcatctacacgacgcgctttgccatcgtgttgatattaggtgctctcctgcttgagaccacgacccccacccgtctgacggcggcgttctcttcgttgctctcaccgctgcggcgactgcattggcatacgcaggagacggcattggtgctgtcgttggccctgcggttcgtgcccacgttggcccaggaggcactctccattcgagatgcgcaggcgattcgtggcggttccatagaatcgggttccctgccacaacgggtcaacgcgatgtgcgcgaccatcataccggtattcgccggcgccatacgccatgccaacaacctgtcgttggccctgcaggcacgctccttcgaagaggggcgcccccgctccacctggcatgccatgcacatacgcggccgtgacatcgtgttcatgacgctcaccgtgacgacgttggcggccataatcgccatgaatgtgttcaccatatgaattgtagttacgctcaaaacgaatactcatgcaaaatattcacaacgacacccgtcatgtacgatgacacaatcaccgcgcacggcggcgccgacgaatgaggttgacgcgaatagcattgagcgccgttccgtccacgtcgaatgtatgacgcacggttcgtcccacaaggacccaatgccgtaggcgacgcacatgagtcgtgaccacccgccgcatggcgggtggttttttatttccgcactcctctccactgccgccttgttctcatagagcacgatgctgcatgtccattgtttggggccattaagatgaaacgcaggagaatatgcccaccacaagtacagaaacgaggaagtcatggcattgcaggatggcgaacataccatcgcactgaacaacgaggtactcatgcccgaaatcggcttcggcgtatggcacgccgaagaaggcccagagacggtgaacgccgtcaaggccgcgctggccaacaactaccgtctcatcgacacggcggcgttctacaagaacgagaagtcggtgggagaggccatcgcctcgtccgacgtgccacgtgaccagatcttcgtcaccacgaaggtgtggaacgacgacattcgcgccggcaagacgaaggaggccttcgacaagagcctcaagctcctcgatctcgattatctcgacctctacctgctgcactggccggtcgaaggctggcagcaggcatggaaggaactggagacgctctaccgcgacggccgcgtcaaggccattggcgtatgcaacttcgagcaggatcagctcgaagagctgctggatctcgccgagatcaagcctgccgtcaaccagatcgagtccaacccgctcttcgccaatcaggatctcatcgacttctgccacagcaagggcattgcggtcgaggcatggcatccgatgggaggtcggggcagtgatttgttcgaaaacgagacgctgcgcgatatcggcgacaaatacggcaagtcccctgcccaggtgatgattcgctggcacatgcagcgtgaggtgattccgctgccgaagtcggtgcatgaaacccgcatcgtgcagaacatccacgtattcgacttcgaactgggcgagaacgacatggcccggatcaacgcgatggacaccggcgaacgtcagggtgccgatccccatcacgtcgacttctgatcgccactgattgcctgcgctggggttgggcgcccacgggacggggagtgttgaggaacgtaaagggcgcttgcgatccagtgacgagacactccccgtcccgtgggcgcccaaccccagcgcatatctcacacgcgtattccgactgtcttcgtattcagcccaacctcgcgatcggcacgcattgacccaacgctcctgtacgatggagcggtctgttacgcacggaatctgtaagacaaccgggtttccaaaggtaggaacaagaatatggcattgacgaagaagcaggtcaggcagctgcgcgcgatggcgaaccagctcaagccgctcgtacagatcggcaaaggcgatctgagcgacaacgtgatcaagcaggcggacgagacgatcgagaaacgcgagctcatcaaagtgcaggtgctcgacggctcgggcatagacgccaaggaggccgcacagggactcgccgatcgcatgggggccgaggtagtccaggtgatcggcaaccgtgccgtgctctaccgtcgttcacatcgcgacgacatcgagcacatccagcttgtgcgcgaatagaacgaatgcaaagcctttacggatgaaaacgcccggcccacatgagccgggcgttttcattggcacatcaatcgcgtgcggcgaagcgcggagcatccgcaaatctgcacgccgataccggatcagcgtgaggtgaggccctcccactgcggtttccaggtcatctggcgctcataggcgctcgcccagaacatgtactcgtattcgacaccacgcacgaacgaatccaccagtccacgccggcgctcctcgcccacgccggcaacgcggcgttcgatctgcgcgagcagccatacggagctctgccagaactcgtcggtcttgtacatgtcgatccactgccggcatggattgtgctcgagtccctgtgcgaaatcacgtgccagtcgctcgccatagtcggcgtacacccacgcgcagggcagcacggacaccaggatgtcgagcagatcgcccgaatacgcggtggtgagcatgttcgtcgtgtaggcgcgcgcgaatgcggactgctggccgtgcagcaccttctcctcggtcaggccgaatgatgccagataatcgcgatgcagtgaggtctccacatgcaggatcgcgtcctgaacactcgccatccatgccatcacctcacggtcgtcggtcttcgtcacggcgagcgcatgcaccttcgcataggcgccgaggtagagctcgtcctgcatcaggtagaatgcgaacttcgaacggtcaagggttccagcgccgagttcctgtatgaatggctgcctgtagccctcttcccataccggatcggcggcctggcgcatgcgcgacgcgaacggtggcaggtcggttctggtgatggtggtcggcatggatttcgccatatgatgtctccctacgtaggtgttagccaacaggttcaaagggtcacgctgtcgcgttctcaactcgtctgagtccccccgcatcttcgtattgtcacatggtcggcagacgaagcgccatgtcgtctccgtgcaggtccctgcatgttcgccgatggacatcgtgcgtttggccgcgtatccatggccggcctacactgtcggtatgagattcatcggtaatttgatctggcttgttctgggtggtctggagatcgccttcgcctggttcgtggtcggcctcgtgctttgtgtgacgatcgtgggcatcccgttgggtgtgcagtcgttcaagatggcccagctcacgctcaccccattcggccaacacgtcgtctatggcggttcggtgggttcgctgctgctcaacatcgtatgggtggtgctggtcggctggtggatggcgcttgggtatctcattgccggtgtgctgaattgcatcacggtgattggcgtgcctttcggcattcagtcattcaagatgtgcaagcttgccctgtggcctttcggcaccaccattgactagtcccgcataaggtggcggtggccggcgaccttggttctcaaggtctccggccaccgtcattgcgtatattcgccagcatcagtagccgtgcgagtgcaggtacttgtcatcgaatccgaaataatgccccagctcgtggagcacggtcttgcgaatctgttcgaccatctgcgcatgcgtggcgcagatgcgttcatgggggcccttgaagatcgtgatgcggtccggcagcacgccggcgtatccggtggtacgctgggtgatcggcgtgccttggtagaggccgagcagctccccgtctccgtgggtcatgctgacgtattctttgtccgtcggctcgtcggccacggtgattgcaatgttggaaagcgcttttttaaaccgttctggaacggagcggaccgcctcggtgacggtccgctcgaattcaggttcgctcatatgcatgtcgacgccttctcaattagtcacggccgagcggattgacaccctcattggctggtgacgtctcgttgtcgaacatcagcgcatgcaaatggttgtcgaggtaatcagcttcctgatgcgcctcggtgtcctccttcggcgtgtggggttccatgggcatctccatgcgacgcaccatgccgcgatcctcgtagaaaccgtagtcgcaatccgtgtcggtgtacaggaagtagtgttccacattgtttactttgaactcattgagcatccagtcgaacagatgctggcctatgccctggccgcgcatgtcctcgcgcacaatgaagagcacgatctcgccgtcataggcatggccgtccttcttcgcctgcttgatcatctgccggtcggctttctcggcgttgagcatgttcttcaacgcctgatgagctgacttgttgaagaaaagcgggcccatgatcttcatgacgctgcgatgatgctggttgattcccttgcgggtctcctgggcgtcgatgcgacccagaacggcgccgaccacctcaccatcgcgtacagccacttctgcggtggttgtgcgtgccaggcagtattcgagatctatctgggcgagcttcatttgcagatcctcatccatctgcggatcctgcttgtgccacgtctcgcacaacatcttcgttaacgctgggtaatcggtgcgctgcaacgtcctgtaactgatcgaatcattcataaccccaagtgtatcccacagccgcatgaggtcattggcttcaacctattggcgtatgcgccgtgactgacgccccttgtgttcctccacgagttccctcatacgcttgagcaggccgacgagcacgccattctccaagcattcggcgaggtacccgtcggaacggcgttcgcggtacacaatcatggtgatcagtgcgctcaccaattccatgtccaacgaacgcatattcaagatcttcggatccacatcggcatcgagcccataacggcgcagcgtcttggtgaagtcagcggaacatcgggtgagcacggaatcgatgaagccgagcataatcggctcatataccacgtatggcacgctgctcatcacacctggcatcgtcatgaactcggtgtgatagaggtcgccggtgtcgctttcaaggggctgaatgtacgcggtgagccattcataggtatccctggaatcctcatgttcgcgcatcacgtcgagcatattggcgtaatgcccgaactggccgcctgtcccatgctcaccctcgcgcatcgacacaccatgttcgacgtcgaggtctatggcgaaccggaactgctgggccaactgcaggattgtggccacctcatgccgacatacgtgcagactttgtgcctgctcgcatgagcacatcatgcgcgacagcaaattatgacgcataatgatgtcgacggtgtgcatttcggtatcatcggccacctcggcatggaaaatgccgaacggcacgaaatgcaactcgcgtacatcaccattctcccatagctgcttgccgcccatcaacgattcaagggagacgaatcgagccagttcggtgatcggcttgccaagtctcatcgacctggctatgagacgcaggcgcgcatgcgtaccggtgagcagaagcctcttggtggcatcgctgatttcgagttcccgcccggcctgttccatctcatcggcatcggaggccgtgtgacgcatgggatcccggttctcctcgatcacccgtcgcatgtcggtgttgagaatttcggtccccggcacacgatgccatgcggcgacaagccgcaatgccttggagttctcgtacagcacgatgaagttgcggccgatcgcggcctgccaccattcgtcgagcgcacagttctcggaatcaagcaaggcatccttcagcaccttccaactgggcaggtggtcgatgtcggtgtcgaagagcttcgcaatgttcgtcttgaacgcctcggaatacatgacgccgccggtgacgcccgaagacatgagcgccctgaacgagcggtaggtcagcggcaccgattcgatgtcacattgttcgtacacagtgccaggaccgtaggcgatgagtggatcctcccctcgtctggaaccgtcgagggtggggtactcgcacagcacgatggcaccgcagttctcgcattgctcgaggattcgccctcccggcagcgtaactccggtgttgaattcgcagtcgtagttgtaatgcgccagcgatgacgacgggatgaagccgaacatgttcggaccggtgtggccgaggccatagaggtgcgcgccgcagatgcattgccgtcggaccatgcctactctctttccactcccctgttcacatgtgcattccgtgtaagcgttacgagaattcccagaatgcacgtccatctggactttatccgacccgaagggagctgtgcgtcgtaatattttagaggaaccgtctaagatgccattgattgtctgttcatttgtctaatttgagcatagttcgctttcagcagattatcaagcgcgtttcacactcctcaagatcgcgtttcaaatgttggtgtcagcgtcgtcgccggcatcggttggttttgattacatgctcatgccgcggactcgagtgcggtcatgatgatctggtcggcgcgtcgttgcatctcgtcggtgatctcggcgcgtcggggtgtgcgcgggttcagggcggttgccatgtcgtcgccgctcatgaacctgcgggtcgcccaggtctcgttcatgtcgacgaggacggcgccgaccaggcggatcagggactcgcgtgaggggaagactgcacggcgcgggtgcgtcgcttgatctcggcgttggcgcgttcctgcacgttgttggtgcgcagcctgacccagtgttcccggtggaacgccagatgggccagcgcgtcctctctcgcgtcctcgagcagttcgccggcgcgccggtcgatggcgccgatgcggacgacggccgcgtcgtaggcggcacgcgtcatggccgcgtccggctggcgtgggacggcggacagggcgtgcatggcgcgcccctggtccttcctgtgcctgatgcgggcggtcaggtcgcgttgcatgtgcacgaagcaacgctgccacgaggcgccgtcgaacacctccatgatcgcgcggcgaaggcccgcgtgcgcgtccgaggtgaccagccgcacgcccgccacgccgcgacggcgcagcgagagcaggaaccgcttccatgagtcgtacgactcggtgtccaccaggtcgaagcccacgaaacgcctcgtgccgtccatgaacgcgccgatcgcggtgacggtggcctgggagcacacgcgcgagtcgtcgtcgcggcacttgacgtaggtcgcgtccaaccacaggtactgcaccggcgagccggcgtcgaactcggcctggcgcagcgcgtcgacctcgccgtccagcgaggcgcgcatgcgcgagacggtcgacgggctcagccggccggactccagctcgtccgcgaccttctcgatcctgcgggtgctcatcccgttgacgtatgccctgtagaccacgccaaccatcgcccggtccacacgcgagtacgggcgcatcacccgttcggggaaatacgtgtcctcgcgcggcttgggcacccgcagcacgatctcgccgatcaccgtccgaagccttctctcacgatagccgttcctgcggttgccctcgcccagcagctcgtcggcctccagctccatcgcgtggtcggccaccgtctcaatcaggcccaccgccagagcacggaaatcgatcagcccgtcctcgcccaacggcatgtcatccatcgtcagggccacatcatcggatacactggtcatcaaggtcatctcctcaaatcagttgtttttggctttaaccgattccaggcgatgacctccttcatacccggagccaaacaccaacatttgacacacaaccctcctcaagctattttgtctatttttgcatgggactctatcggcagttttgcgcgacttacgggttactacgccgtaagaaacacctaaacgggattttgtatcctcaatcctgtattccttaagtatgacaagtgaaaatcattccaacgcgcagcagcccgcaccaagcgcagacgaagtgaccgacgccggcatcgtcaaggagtacaccaccccactcaagcacgagattgatccggacatcaatctgttcgactttctggaagggcgcgcgcagcgcaatcccgacggctccatggtgagctacaaagacgccaacggcatctggcagaccttctcggctactgagttccgagacaaggtggtggccatcgccaggggacttatcggatggggcgcacgcgcaggcgaatccatcgcgatcatcgcgcacacccgttgggaatgggtggcccttgacatggccatcatgtccatcggctgtgtcaccgtgccggtgtatgagaccaactcacctgcgcaaatccgcatggtgttcaacgacgccgaagtggtgctcgccttcgccgaggacgacgcgcaacgcgacaagctcgaatccatcgccaacgacaccccatcgatgcgtggttcattcgtcatagattcggccgccattgacgcaatcatcgccttcggggccaacgtgaccgaggagcagttcctcgagcgcaaagccgccgtccatggcgacacgttggccacaatcatctacacctccggatccactggcacccccaaaggcgtggaaatcagccacgggaacatggccgccgaatgcatggacgccctacagtacatgcctcgcgcaatagacatccccgaccgccgcttgctgctgttcctcccgctttcccatgtgttcgcacgattcatggccacggtggcctttgccggcacactcactctcggcctcaccagcaatatgaagacgatcatcaaggacttcgaggacttcggtcccactctgctgctcgccgtcccgcgcgtattcgaaaaggtgtacaacgccgcctcccaacgtgcaggcactggtttcgccggccgcatgttcgcccgcggcgtacgcgtggcacgcgaatggagcaaggccaagcaatccggcaacggaattcccgcaggcttgcgcatgcgccatgcgttctatgacgccgttgtctacaagaagattcgcacggtgttcggccgcaatgccgacttcgccatcaccggcggcgcgccgatggactcggatctggcccatttctacaatggcataggcatgccgctgctcgaaggctatggcatgacggagacctcgggacccgtttgtgtctcattgcctgagaacaaccacatcggcaccatcggtcagcctctgtgcggcacgaccgcaggcattgccgaagacggtgaactgtgcttcaaggggcgcgacatctgcatgggatatcacaaccagccggaggtgaccaagcagcagattgtggatggctggctgcataccggcgatctgggtgacatcgacgatgagggtttcatccacctcaccggccgtaagaaagacctcatcatcaccgccggcggcaagaacgtctcccctgggcatttggaaaccactgtgatgacttcgccggtcgtagcccaatgcctggtgatcggtgaccgcaagccgttcgtggcggctctcgtcaccctcgacctcgaagatgcgaatgcatggttgacctcgcagggagccaaaccggcagccgatctggaagagctttcaaagaacccaatcgtgcacaccgaagtggagcgcattgtgaacaaggcgaacgaaggggtctcccgggctgaatcgattcgcaagttcgaaatactgcccgacgaattcacttcggaaaacggcatgctcacaccaagtctcaagacgcggcgcaagcagatcatcgaccattaccgcaaactcatcgacacggtcatctacgtgccacgcaaaaaagccagctgaccagctttcggaatgcatataaggaggcctgtgcgattcccgggaatcgcacaggcctccttatattgcgcatggcctcatgcacgctgctccatgcgggctttgttcagggcaaaagcccgagccagcataatccaagacactgcgacaatagccagcatgacggcgaaagtccatgtgccgccaaccgcagtggcatgcctgtatacaggcgttccctcggcaccatgaccagcctgcgcgatggccaggattgtggagaacagcgtggtgccggccgctccaccgaattgcagcgcggtgttgaacacggcgttcccatccggcgtgaactcatggtggatgccggagatggcgtccgtcatgatattcgagaagccgagggcgtaccccactccgaagatgaaatagaacgacgccatgagcacggacgtcagatacatggagaagcctaggaatagcaccaaggcgccaaagcagcaggcgaatgcccccagaatgggcttggtgggaccgtgcttgtcgtacaacatgccgccaaccggcgcaaagaacgcgccgatgagggcccccggcagcacgagcatgcccgcaacgagcgcactcgtgccaaggctcagctgcgcaaggttggtgatgacatagccgaagccgattcccaccatgggcagcagcgtgtacggaatgaggtggagcatcaccaccttgtctttgagccatcccagacggatgagcggcgagaacgagcggcgagacgaccacacgaagaacacaagggcagccacgccgacagcgagactcacgatggcgatggcggccgaccggccccacggctcaccggacacgccctcacttacggccacgccaccttggttcagcgagagaatcatgccggcgagtcctacgatgatggcgaggaattgcaacggattcagactcaccgcctccgtgggcttcgtctgcgtgatgcacttgagtcctatgggcaacgagatgagcacaataacggggatgacgatgacgaaaatagaacgccacggccagatactggccacagcgccaccaacggtgggacctatggccggtgcgacggtgatgacgagcgaacccacgcccatgagcctacccaccttggagcggggagactgctcaagaatgatgttgatcatcagcggcgtcgcgatgccggaacccacaccttgaatgacgcgggcaacgatgatgacaggaaagctggtgcccacgatcatgatgaacgaaccgacaacagcgagcgccacagccgccacgaatacggatttcattgtgaaacgacgcttgagataagaggagacgggcatggtgacacccaccgatagcagatagatcgtggtgatccattgcacggtcgcagtgttcaccgagaactccaccataagttcggggaacagtacggtcatcacggtttcggtcaggattcctatgaatgccagggatcccaccgaaacgatcgagccgatgagcttcggggaaatgcgatcgtcattcgccgccgggttcgcgatcctcttctttccgccctgtgtcggtcgcgtcgtcattcttgcctttcatctgtgagcgttgagtttcaccgggatgctcggtatgcgcaggatctaccggttccgtcggtttccgttctgtctgggtcggggccggtggagccggttcgccgtgtatgatggcgcgaatccggtcgagccgcgggcctatctctcgttcatagccgcgactgttgggatgatagtattcacgcccgacgagcacgtcaggcatgtactgctgttccaccaccgcattcgggtaatcatgggcgtagtggtacccttcgtggttgccccacgatttcatcaatgtcgtgggtgcattgcgaatatgcagcggcacctgacctatgagccccgcatccacatcggccaatgcctgattgatggccgtatagctggcatttgacttcggcgcggtcgccaccgctatcgcagcctccgatagaatgatccgggcctccggcatgccaatcatctgcaccgcctgcgccgcggccacggtgatctgcaggatctgcggtgccgccataccgacctcctcggcagcggcgatcatgatgcggcgcgcgatgaacctcggatcctccccggcccggatcatgcgggccaggtaatgcagcgtggcgtccacatcggaacctctcatcgatttgatgaacgccgagatcacatcgtagtgatcgtcaccgttcctgtcatacctcacagccgccacgtccatcacggtggagaccacgtctgtggtgatttcggcaggaacattcgatcccgattcgtcaactgcacctgctgcggcctcaagtatggtcagagatttcctggcatctccgcccgccagacgaatgatcccatccacggcatcgccttgcacgcgcaccttgccgcccaagcctcgagggttcgacaccgcccgttcgatcacggtccgaagctcttcaggttccaacgattcgagcttgaccacgacggaacggctcaacagcggtttgatcaccgagaagctcgggttctccgtggtcgccgcgatgaaggtcacgtcacggttttccacgctgggcaacaatgcatcctgctgcgatttggagaagcggtgcacctcgtcgatgaacagaacggtctctttgccttgactcaccaatcgctcatgggcacggcgcaacacctcgcgaagatccttgacgccggacgtgacggcggagagctcctcgtactgccggccggattgcttcgcgactatatgggccagtgtagtcttgcccacacccggtggcccgaatagaatcaccgagctcggggcggtgagcgaacccgtcgaggccgagtcggcgagacggcgcagcggggatcccggcgcaagcacatggcgctgccccaccacttcatcgagggtggtcggacgcatacgcaccgccagcggtctcaccacctcttctgatgggtcgctcgccgcgaataggtcgttcgtcatgtcatcgctcatagacaacagtgtagccaccaagacgaattcgaacaaatgttcgacgctatggtgtgtccatcatgctcttcgactagcattgcaacggaatatggatgcgcaggcgtgaggaacgaacatggcagaggcagatgacgaacggacggcattgatgagattggttccctcccgaggggaggacaaccgatcgctggatgccgatgagatctatgagcgattcttcgactgggtggtcgaggagcgtggcatagagccgtggccgcatcaggaggaggcggtgctcgacctgctggcgggggatcatgtggtgctcaacacacctaccggctcgggaaagtcactggtcgcgctgggcatgcatttcgcggcattgtgcaccgggcggcgctcatactacaccgcgccgatcaaggcactggtctccgagaagttcttcgagctggtcaacgtgttcggcagggagaatgtgggcatgatcaccggcgactcgcatatcaacgccgaagcgccgatcatctgctgcacggccgagattctcgccaaccaagcgttacgggaggggcgtcgggctgacatcggctgcgtggccatggacgaattccattactacggcgatcccgaacgcggctgggcatggcaggtgccgctgctcaccctcccccaggcccagttcctactcatgagcgcaacgttgggcaatgtggacacgattgcagattcgctcgaggacctcaccgacaccgacgtggacatcattgccgaagcacgccggcctgtacccctcagctaccgatataccaccgatccacttgagaagacggtggaactggcggtgcagaacggtgagacccccatttacatcgtgcatttctcgcaggatgccgcactcgacaccgcgcagtcgctgtcgaacaccggggtttccaccaaggagcaacgcgaggcgattgccagggcgatgaagggcacgaagttcacaacgggcttcggaaagatcctccaacggttgctccgcaccggcgtgggaatccaccatgcgggcatgctcccccgctaccgccgtctggtggagcaactcgcccagcaggggctgctacccgtcatctgcggcaccgacacgcttggcgtgggcatcaatgtgccaatccattcggtggttctgacgcagctgaccaaattcgatggcacccatatgcgaaaactgcgtgcacgtgagttccatcagatagccggacgcgcgggccgctcgggcttcgacaccgaaggactggtgatcgccgaagcccccgaatacgagatcgaaaacgcccgtgccctggcgaaggcaggcggtgatccgaagaaactcaggaagatcaagcgcaagaaagcaccggagggattcgtgacatggaatgagtccaccttcgccaagctaatcgggaaagaaccggaaacgctgatcccccatatgaagataacccattcgatggtgctcaatgaagtcgcccagggaggcgatgccagaaaacgcatcgaccggctcatcgaagattccgcgcagaccgatgagcagaagaacgcacttcgcacccgcgccgatgagatcttccgcacactcatcgacaccgatgtaatcgaaatcgaacaggaagacggccgcgactactactacaccaccgtcgatcttccgcaggatttcgcgctcgaccagccgttaagcccattcctcatcgccgcccttgaattgctcgatcccgcttccccgtcgtatgcactcgatgtgatctctatggccgaagccacgttggaagatccaaagcagattctgcgcgcccaggagcggcaggctcgggacaaggcgatggaggagatgaaggccgatggcgtcgattacgatgaacgtctcgaccgtctgcaagacatcacctatcccaaaccattgaatgacctgctcactgaagcattcgaccagtaccggaaagacgttccctgggccaacgactactggatcaatcccaagtccgtggtgcgcgacatggtcgagactgcatccgacttcaacggctacatcgcccggtacaacgcagcccgttcggaggggacgctgttgcgctatctgtctgatgcataccgtgtgctggccagaacggtacccccggagaaacgcaatgaggaactcgacgacatcatcgcatggttgcgcgttctggtccgctccattgactccagcctcgtggacgaatgggaaaacgccggcacacaggcgcaggaggccgcgaacctcgccgcaccgaatgtggccaacgccgtggtggaagatcgtcgcgggctcatcgtgctcatccgcaatgcgatgttccgccgtgtgcagctcatggacctcgaccggcctgatgagttgggtgcactcgacaaggcatggcattacgatgtgcacacgtgggaggatgtgctcgatgacttctatgacgagcacgagtacgtgaacacggatgccgaagcccgtggtggtgagtatttcgttctcgacactcgccatgagcaggatcgccacgagtggacggtgcgccaaatcatcgatgattccgacggcgaccatgactgggcaatcaccggcactgtgaatctcgatgccacgcaggaaagcggagaagtggtgttcaccgactattcggtgcgtgacgtagtcaacgacaacgatgccgccaccgtaaaagcgcagtgagacccaaatagtattcactcgacgccgagtctggccaacgcctcatcacggtcggcgtcgagtggcggccaggtctggttgaaattcttcatggtcgtgcgcagcaactcagaaacgaccatacgtgagtaccatctcttgtccgcggggatcagataccacggggcaatcgaggtgctcgtccgttcgaatacctcctgccaggccgccatgtaatcatcccatctgtcacgggcttcgagatcggaggggtcgaacttccagtatcgtgtcggatcatcgagacgtcgcaggaagtgctgtcgctgcgcttgcctgctcgacacgagaaaaatcttgatgatcgcgcaacctgacccggcgagctctgcttcgaagtcattgatctgcccataccgtgcgcgccatgtctcctcaggcagggaacctgtgatgcgtggcatcacgatgtcctcgtactgcgaacgatcgaagatggatatccagccatttgacggcaactccctgcgaatacgccacaggtagtcatgggcgagatcctcctcgcttggtttgccaaagccatggtagtgaatacccattggatccacctgactgaatacatggcgcacaatgccgcctttgccggaggcgtccatgccctgcagcacgatgagcacgcgatgcgtgtcgccatggatgccattggcatacatgagccgctgatagttggctatttcggagctgctgtcggcaatgaaccgctcaccagcctcttggtcaccgtcaaaccccggtttcgacccggcatcgatgtcgaccaaatgcgtatgtgaatggaaccgcaataactgcgccgggggcaacgaccatacggcactgagcgtttcactgctcttcgcctcccgggcgaggcgttcggccaccttcctggccttgcgttctgccaccgtgattgattcgccttttttcgaacctctgccgtttttcttgtcgcttgccataccaacattctaggcatgtgacacgtgcactggccaaaaacgaatgtggggtgcgcagatgcgcaccccacattcgcatgccgtatgcgttatggttcacatggatggtcggtcaccgctcccctgcacccttcgaatggtggtgcatatggtgctcggccggaacatgctggctctgtggctgtgtttcatcgtagccttgcacatagcgcgtgcgtcgccatccatggatcctcgcattggtgccacgatggtgcacatgatagaggcgctgggaaccgccaagcgggcgcccctccttcgccaccgcgatctggttgacgttggacgggtccatgatggcaatcggtgccaccggctcgggctcggttggcgcgagtgtgtgctgctgcatgcgcaccggcagccattcagccagtctcgacagcagccagcagatgatgaagtagatcacagcggctacaacgagcgtctgcagaatattgaagtacatcgagcctaagcgtcgcgactcctgcagcagatcggtgtacatgatgatcgaaccgagcgccgtgtctttgagcacgacgacgagctgggtcacggcagcaggcagcatggcgtagatggcctgcggcacttcgatgctcatcagcgactgtgtacgggtcatacccagtgccactgcggcctcatgctggccgcccggcaggtttccgacacccgagcggatgagctcggcgacaaccgaaccgttatagaacacgagcgagatcacgacggcccaataggaggggctcggcagatccaggaaggcgaatgcacgccagaagaagatcatcatgatcagcaccggaactgcacggcagaactcgatgacaatcgcgcagattccctgcacgatcctgctcggcagcagacgaccgatgccgaacaccagaccgaacacgaccgaaccgatcaccgccaggaacgccgcgcgcagtgtggcccataggcccggcagatagaagtccgaccacgcttcaccgtccaacgccggcttccacaattcccagctgagctggttttcgccgtccggtggattgtgcagacgcagcacaatgagcacgagcacgaccacgaacagaatcgtggccacccagttgatgatgcgaatgcgcttgaggcccttggggcccggctggtcgaacagcagggagctttcgtctgaattacccacggttcacctcctgactgcgagcttgttggacaggtacgtggtgaggatgccgatcggcaggatcagaatcacgtatcccatcgcgaagatgaggaagatctggatgatcacatcgggccggaactcgatcatctcgctcatgagcgatgaggtctcggtggccaccgacgccgctgcagcgacggtcgagttcttgagcagtgcgatcagcgtgttgccgagcggtgcaacagatcctcgaatggcctgcggcatgatgatcagtgtggcggactgcatgaagttgaggcccatggcccgagccgcctccgcctgccccttgggcaccgtattgatgcccgagcgcaacgattccgccacgaatgcggcggtgtacaggctcaggccagtcacggcgagccagaagaagttcgtctggaagttgtcggagaagctcagcttgagctgcgcgaacgcgcccagcaccatgaacaccatgatgatcgtcagcggcatgttcttgaacagctcgacatagccggccgacaccttgcgcagtgacgaaaccggtgagatgcgcatcatgacgagaatgagtcccagaatcgtcgagaacagcgcagcccatagcgtcagttcgatgttgacgaggaacgcaccgggaatgttatagcttctgaacagggaaatgaatccttccatgccgctcactccccttcgtccggtgtcggtgggttatatttcggatccggttggtaatcggtgccttcggtgttcttctcgatggcccgttcccactcaccgctcttgatcatgtcttcaatggcggcgttaatctgcttggcgaatgcggtgtcacccttcctgatgcccaccccgtagtattcctgcgtgaacggcttgcccaccacacgcagcttgccacgggacgccgaggccagaccggccagaatgatgtcatcggtggtcaccgcgtcgacgatgccggagaagagcgccgtggcgcattcggcataaccgggctgctccatcagctggacctccttggcgaatctctccttcaccaccttggccgacgtggaaccggtcacggagcacaggcgtttgccattgaggtcctccggaccgttgatcgaatggtcgtctgcgcgcaccattagatcctgccccgccacgaagtacggccccgcgaacgaaaccgccttcttgcgctcgtcggtgatcgaataggtcgccaggatcatgtcgacatcaccgttttgcaacatggcttcgcgttgtttcgacggagcctcgaggaactcgatctcggcatcggtataccccagttgattggctacatatcgtgccacgtcgacgtcaaagccttcgaatgtgccgctcttcttgaatcccaagccaggctggtcgtatttgatgccgatcctgattttcttctcgccgtccgccgacgacgaaccgcaggccgccatcccgaacagcgcactggcggcgcacaccatggcgattgccttgcgcgccaaccccttcttgtatctatgtttcatcgttctcccttcaccgagccatgcatgacgaaccagattccgctctcctcaacggaatccataggcgtgcatggcccatactgcatcagtgcgtgagaatcttcgacaggaactcctgggcacgctccgtctgggggtgctcgaagaactcgtcgggcgtgccacgttcgagaatctggccgtcggccatgaacacgatcttattggccgccttgcgcgcaaaacccatctcgtgtgtgacacacagcatcgtcatgccttcctgggcgagttcgaccatgacgtcgagcacttcgttgaccatctcagggtcgagcgccgaggtcggctcgtcgaacagcatgaccttcggatgcatggccagcgagcgcgcgatggccacgcgctgctgttgtccacccgatagctgcgacggcatcttcatggcctgcgaatcgacgccgactcgcgcaagcaggtccatggcctccttctcggcctgatcgcggtccatgtgacgcaccttgatcggcgcaagcgtgacgttctccaggatcgtcttgttcgcgaacagattgaacgactgaaacaccatgcccacttcggcgcgcaactgggccagacccttgccctcctggggcaatgcctggccgtctatgcggatgacaccggagtctatggtctccaatcggttgatggtgcggcacatcgtcgacttgcccgagcccgacggtccgacaatcacgagcacctcgcccttgtctactttcagattgatgtcgcgcagcacatgcagattaccgtagtacttctccacatgctcgagttccacgagatgatgggcgttctcgccgctcggcgacaattgttccacagtgttgttttcgctcatagcggcatagtttataatcccatgtgtaacgagatgttacctctgttcgctcatcacggaatattgggccgatatcatgcaaaatcaatgcccctgatgtctcatattccgaaataaatagacatattatagtcttttgtatatttcggcagaatgagtgcaaacgagtcacgccacctcatgatgcgtctgaaggaatgccaccgcctcgcctatcgcacgcatgcggtcatcgccgttgaacttgtggtcgaggttcgtgtacaggctcacggtgcagttcgccatagcgttgccgtagttgtgcgcgcagctggggtcgatcaccttgtcctgctcaccctggatcgccagagcgggtcccttgaacatcgcagccgcctcatacaccggaatcgtcttggcgatgcgagagtatttgcctgcgacctcatgcttgccatccgcgagcgcgatgcgccgtggaatgtgataggggtcgaatgggacgccaagcacacgcccacgcaatgcgtcatccttgatcgaggccgcaggcgaaagcaggactagggaatggaccacatcggcatacatacccgccgtcatgcctgcaatcacaccgccttgtgaatgtccgagcaatgagatctccgctggctcgaaacgatcacgtacaaaattgagtaccgcgatggcatcctccacctgattgcagacgtcggaattcgcaaatgatccgtcactgttgccacgaccgttgaaatcgaacctcacggacgtgaatcccgcttcgacgagctggtcgctcacctgctgaagcaggctgccgggttcataccccagatcggccatgaacccgtgcatcagaatcaccaccggccctttcggttcgccctgtggtgcgtcgatgcgtccatgaagcctcagcccatcacgcatcacggtgatttcctcggtatgtgtgctcgtcgtcatattgcctcctgcatgggatgcacgtactggtgttctgcatctcatcgtaatgcgaagaacccggttcttctcgattcaagctattggctataacagacgcccccatacatgacggaagcggccgccccgcctagggtcggccgcttccgtcatgtatgggggcgtggatgcgatgcaatcacatgatggcgttgagccactgctccttggtcgccttctcggcctccagcttcgccttcttcttggcgtccgactccttggcgatctgttcgtccaactcggcgagctgtgccttgagctggccttcgaagctcgacttacgggcatcggcctcgggatcggtcttcttccaggcagcatcttcgacggccttgatctggttgtccacggcatccagacgaccttcgatgcgacgcatgtcctcacgaggcacatagccgatctgatcccactcctcctgaatctgcgcgagcttgacacgtgcctgcttggcctgttccccggtctccaccggcacgagtgcctcggccttcgccaacagcgcctccttctgcgccagattctccttctcgttggagctgatctgttcacggtcggcctgacgcgcattgaagaacgtatcggcggcggcgcggaactgtgcccacagtgcatcatcctcattacggccggcacggcctgccttcttccaacggtccatgagttcgttgaacttacgcgaggtctcgccccaagctgtggaatccttgatttcgttggcttcggcgatgatcgcctccttctgcgccttggcatgggaccgctcggcatcacgggcctgagcccatttgcgccgagcctggttgaaggtggtgcgtgcccccgagaagcgcttccacagagcatccgcctcggctttgtcgatgcggatcgtagtgcgctgatgctcctgccactgctcgaacagcgaacggaacttgtcggcagtggaacgccagttcgtgttatcacccagtccggcggcaagggcctcggccttctccacaatggaggtgcgttcggcgattgccttggtcatggcctccttgcgggctttcgcgatggcgtccttcttcgccgcagccttcttgcgcagctcttccaactgcgactggagtgcggggatgtcgcccacgaccgccggctgcttgacttcctccgtcagcgcggcgagcgtctcgtcgatctcacggggcttgatcgaattggacttgagtctatttgcgaatacgtcgagtttggccttgaggtcgaggtaacggcgcgcgtacaaggccaatgcctcgtcggccgacgcatcggggaattgccccacctcacgctcttcctcgccctccttcacgtatacggtgccgttgccatccacacggccgaagctctccgcctccttgagctctacatcgtcatgtgacgacgatgacgccagatgagccacagggctcttggcgagaacggccggtgagggagcatgcgccttcatggccgccgggctcggcacggctgcggccggcgtcgtcgcctcgtcgttcgcgactgcgttgtctgtggtcttggattcggtgacgttggaatcggccatggtcagctccttagcttgcgagatggggaggggaagcacattcccttcctcggaacacactagcccagtatagacaagactcacgatagtccgccaccgacgtttttccccgaccccacttattatatggaacgtggcaaaaggtgcatctatatcaggtttcccagaatggctccccgctgaacgcgtggtggagcagcgtgtcatcgatacgcttcgtgaggtattcgagctcaacgggttcatcggcatcgaaacgcgtgccgtcgaacaggggtcgagtctgttgaagaaaggcgagacgagcaaggagatctacctgctctcccgtcttcaggaggtcggccatgaatccgacatccctgtcgaacaacggctcggcctgcacttcgacctgacggttccgctgagcaggtacgtggtggagcattccggcgcgttgccgttcccgttcaaacgctggcagattcagaaggtgtggaggggcgagcgcccgcaggaagggcgtttccgcgagttcgtgcaggccgacatcgacgtggtcggcgacggcacgctcccttcgcactatgaggtggagctcccgttggtcatggtgaacgcattggaacggctgcgtgaattcggcttgccgaaggccaccgtgcacgcgaacaaccgcaagctgtccgagggcttctaccgtgggcttggtctgaccgatatcgagggtgtgctccgcgagattgacaaactcgacaagatcggcccccaagcggtgaccgatctgctcgttgagacctgcggtgccaccgaggcacaggcgaatgcctgcctggagctcgcacaggtcaccgcggaggacggccaggagctcatcgagaagttcaatggactgtgcgaaatccaccatatcccgttcgacggcgacgagtacgccatggccaaggagggtctggacaccctttcaatgatcatcgacgaggcccgccgcattcgccccggttcggtcatggccgatctcaaaatcgcccgcgggcttgattactacacgggctccgtgtacgagacgttcctcgaaggagcgagcgatctgggatcgatctgctcaggtggccgttacgataatctggccacgcagggcaaccgcaaataccccggggtgggtctctcaatcggcttgtctcgcctggtctcctacatgctgcacagggcgggcgccacggcaagccgcatgtcgccggcatgtgtgctcgtggccgtatgggacgaggagaaccgaggggattcgaacgccatcgccaatacgttgcgttcccgcggcatcgcggccgatgtggcgcccacggcggccaagctcggcaagcagatcaagtacgccgacaaactcggaatcccatacgtctggttcccgaacgagaaccccgagaacgacggcagcgacgaggtgaagaacatcatcaccggagatcagcgtccagctgatgcacagtcgtggcaaccggatactgtgtatgcccagcaaaccgtttccatcaatgccgacaaccgttgaaaaatcggcgttcagaacagttttatccaagaacaatgcaatggagaatagaggaagcatgagccagcagacggcttatcgtacacatcacgccaccgacgtgaccgaagttctggtcggcgagcacgtcacgcttgccggttgggtggaccgccgccgtgatcatggcggcgtggccttcatcgatctgcgtgacaacaccggtctggtgcaggtggtcatcaacgaggaggagatggctcgtccgctgcgcagcgaatatgtgatcgaggtggacggcaaggttcgccagcgtccggagggcaacgagaacgaccatctggcgacaggcaaggtcgaggtcgtggccgagaagatccgcgtgctcgcaaagtccgacgcgctgcctttccaggtgtccaccgcactcgaaaacgaatccgagaacaagctgccgggtgaggatgtgcgtctcaagtaccgctacctcgatctgcgacgcccggccatgcagcgcaacatcaagctgcgttccgacatgatgcgcgccgcccgcaccgagctcgacaagctcggcttcaccgaggtcgagaccccgacgatgatcaagtcgacacccgagggcgcccgtgacttcgttgtcccggcacgtctggttcccggttcctggtatgcgctcccccagtccccgcagctgctcaagcagctgctcatggtggccggtgtcgaacgttactaccagttcgcccgctgctatcgcgacgaggatttccgcgcagaccgtcagcccgagttcacccagctcgacatggagatgagcttcgtggaccaggaggatgtcatcgccatggccgaacaggtgatcaaagccatctggaaggccgatggatacgacattgagacgccgatccgtcgcatcccatggcaggaggccatggacaagtatggctccgacaagcctgatctgcgcttcggaaacgagctcatcgaactcaccgattatttcaagaacacgccgttccgcgtgttccaggccccatacgtgggcgcggtgctcttcaagggcggcgcctccactccccgtcgccagttcgacgcctggcaggattgggccaagcagcgtggtgccaagggtcttgcgtacgtcgtgttcggcgagaatggagagctcaagggacctgtcgcaaagaacctctccggcgaggaacgcaatgggctcaaggaagctgtgggtgccgaggatggcgatgccgtgttcttcgcagcaggtgcccgcgaatcctcccagttgctgctcggtgccgtacgcgtcgaactcgccaaccgcgccggtctgctcgacccgaagaaattcgcattctgctgggtggtcgacttcccgctgttcaagcgcaccgacgacccggacgacgacgacgttgcagtcggccattccaagtggacgtcgatgcaccacccgttcacaatgccgtcgaaggactggatcgacaccttcgatgaggatcccgagcatgcgatgagcgattcctacgacatcgtgtgcaacggtaatgaaatgggcggcggctcggtgcgtatccaccgtgacgacattcaggaccgcgtactcaatgtgcttggcatcacgcctcaggaggctcaggataagttcggcttcctgctggaggcattcaagtacggcgcgccgccgcacgcaggcattgcactcggctgggaccgcacggttgccctgctcgccggcgcggattcgattcgcgatgtcatcgccttcccgaaggccggtggcggtcgcgatccactgacaggcgcacctgcaccgatttccgacgaacagcgtgcggaaaccggcgtggattacgatccggaagaggatgaggactgacttcctcgccaaactgctaagagcatggggaatggggatgcacagcaaaactgtgcatccccattccccatgtgttgtggcacgcgtcttcctctctgcacagacgcgtgccacaacacccgccgtcgcatacccccttgcacactcggcctgtttcctgtttcccttttctgtattcgctaccctcccctatgtttctgactatacagctttccgaaataagataccctatttcttaagtattcttcacatactacccatattccgtattttttcttgtcttcgtcgatgttttaccgatatgaattcaatgatgtcttcactggcgggaaacgaaaggggcggcgcggacgggattcccgtccgcgccgccccttattcggcgcttatcgtctcgaggattattcggcctcactcgccgcagccgcaggttcgggcacgacatccttcgactcgtccccttcgcctgccgccgggagctcgaaaggctcgccgcggaacgtgaactccccgagaatgccatcaccttcggcatcgacgatcacacgttcgttgtcgtgcagatcgcccatgagaatcttttcggaaatggtgtcctcgatatcacgctgaatcacacgacgtagcggtcgggcaccaagcaacgggtcgaagcccttttccgcgagcaaatccttggccttatcggtcaggtcgagctccatatgacgttcgaacagacgatcgttgatcttcgtgacatcgagatcgacgatctggcgcacctgcggttcggtgagctggcggaacacgatgatgtcatccaaacggttgaggaactcggggcggaactgctgcttgagctcgctcgacacctggtccttcatgcgctgatagctcgattcggtgttgccccccatcgtgaagcctgtattggcggtcttcgcgatgtcacgcgtgccgagattggtcgtcaaaatgatgatggtgttcttgaagtccactttgcgcccctggccatcggtcaagtggccgtcatccaacacctgcagcaatgtgttgaagatgtcgggatgggccttttcgatctcatcgaacagcacgacggagaacggcttgcggcgcaccttctcggtgagctcaccaccctcctcataaccgacatatcccggaggggctccgaacagacgcgaagccgcgtacttttctgagaactccgacatgtcgacgcgaatgagcgcatcctcatcgtcgaacaggaactgagcgagagccttggcaagttcggtcttgcccacgccggtggggccggcgaagatgaacgatcccgccggacgcttcgggtccttgagtcccacacgtgtacggcggatggagcgcgacagcgcagagacggcctcatcctgaccgatgatgcgcttatgcagctccttctccatcgacatgagcttcttggattccgcctgggtgagcttgaacaccggaatgcccgtgctctgcgagatcacctcggcgatcacatcctcatcgacgaccatacggacgtcggattcgccctcacgccaggacttctctttctctttgcgctcagcctcaagcttctcctgcttgtcgcgaagctcggcggccttctcgaactgctggtccttgatcgtctggtccttctccttggcgatgcgcgcaatgcggttgtcaagctccttgagctccggaggcgcggtaaggcgcttgatgcgcagacgcgcacccgcctcatcgatcaaatcgattgccttatcgggaaggttgcggtcctgaatgtaccgtgccgaaagttctgcggcagactgcagtgcaccatcggtgatcgtcacatggtggtgattctcgtagcgtgcacgcaaccccttgaggatctcaatcgtctcggcaatcgacggttccgacacctggatcggctggaatcggcgttccaaggcggcgtccttctcgatgtacttgcggtactcgtcggtggtcgtggcgccaatggtctggagctcgccgcgcgccagcatcggtttgagcatatcggaggcaccgagagccccgtccgcggagccagctcccacaatcgtatgaatctcatcgatgaacagcacgatgtcgccgcgggtcttgatctccttgagcaccttcttcaagcgttcctcaaaatcaccgcgataccgcgatcccgcgaccatggaacccagatcgagcgaatacacctgcttgtccttgagcgtctccggcacatcaccggcgacgatcttctgcgcaagtccctcgaccaccgccgtcttgccgacgcccggctcaccaatcagcaccggattgttcttcgtacggcgcgaaagcaccaccatgacgcgttcgatctcagtgctgcggccgatgaccgggtcgagtttgccgtccttcgcctcggccgtcaggttgcgcccgaactgatccagtatggcggaaccgctctggctgcgcttgtcctgcacggaacccgcgttggccatgtcgcccttgtctccctcaccgttgccggagttgccgcgaatcatgtcgatcgtggtgctgcgcaggtcggaaagatcgacgtccatcttgatgagcacctgggtgcccacgccctcaccctcacgaatgaggcccaacagaatatgttcggttccgatgtagctatgccccagctgcaacgcttcacgcagcgagagctccagcacctgcttggcatgcggagtgaagggaatgtggcctgtcggagccgcggtgcccttgccgatcatctcctcgacctgcttgcgggtgtcttccaacgtcacgcctttggcttcgagagccttggcggccacgccatctccctcacgaatcagcccaagcagcagatgctcggtgccgatgtaattgtgctggagggcacgagcctcttcctgcgcgagcacgatgacccggcgcgcacggtcggtaaaccgttcgaacatgcttgtccttccataatcaatacaattccaaaccactctacagaattcgcggaacgtttatttccgttttcccgcgaaattgcgggatgggcgtatacggcgcgtgccgcatatgcggtgaatggcatgtactcgctgaacagatttgaccattgtattattcccatcgcgctatttcgcatcaccctgcatgccgagcaggaccccatgctgatcgctcacgcaccgtgtgtggagcatgacacctcgtgccacttacactatgcttagatgtagtgcgtattcgaccaacggcaaggagatgtcatggaaccggcaacagtgcagtcgctgaacccacagggagatctggtggtgggtgtggatggctctcaggaatcgttcggcgcattgcgttgggccttgcgtcaggccgcactttccgggcagaccgtgaacgccgtgtacggctggtcgtattcgtgggacatgggacctgaacccaccaccgacgaggagctcgcgaagctgcgcacgcagatcgccgaaaaacttcgcgattgggtgaaggatgctgccgaaggcatcgacatcgactctgaccagatccgtctcacctcgttccgagcctcgggcacatctgctctgcttgagattggcagcgacgcccagcagatcgtcgtggggcggcgcacactcgggcgggtggcccgctggttctccggctccctgtcgtcttcgctcgccgaggaatcgcagattcccgtgacgatcattcgcgtggagaacgaggatcaatcggtgcaggatgagattgccaacgcgctgacgcccggttctcaagaagttcacttcgaattgcccgcacctgacacgccccgaacgagccgtccgatcgtcgtcggcgtggacggatcgcccacgtcccgtcgggcactcgagttctccgcatggttggcgaatctgaaccatgcgcccctccatgtgatgtactgctggcagttgaaggacatgaccgacatccccggctatgagacaagcgtgccacccctcgatgtggcacagcagcatgccgaacaggtggtgcagcaccttatcgcctcaagcacgctgcccgaggggctcactatcaaggcggacgtcttccatatcagcgcaggcaagggattggtaagcgcctcacgctactgccgccatattgtggtcggttcccgcgggctctccggggccgatgcgcatttcctgggttcggtctccaagcaactcatcaacctcgcggaatgcaacctcaccattgtgcactgattctcggctgtcagcattcacccgagatatcggctccatgaaggagcagatgcccttgcattgacacgccatctgttcactttgagctacacctccattgccgcagccagagccactccctacactggggctctggtatggcaacggatagatgggtggaataaatgagtgcggatgacgagtctgcagacaatgtcggcgaaacgagcgcgcagatgaccgcagccccagagtcagtgacgcaatcgacaacggacgatcaggatgaagtgcatggcacggtagtgccaccgtcattccccccgcatcatgaggagacggatccggcctcggatagcgaagataccgatgccaagcagcgcccctcgaagagcgcccgcggcggagccagacggcatctgcccatgcatatcaccacgatcgtgctcggcatcattgtgatcctaatcgccggattgtacctgtatgccaatgggaacatatcgggaacgcctcgcgcggccgcaatgagcgattgccgatccagcgtctctcacgcgaattcggcgcgcagcctgctcaccaccgcagtgggcgatgcgaaaacataccgggcatcgcatgtcacagacatgtccgatgagcaactgcgcaatttgacctcgtatctcgaccaatccgcacaacagccgtcggtgccgtcatgctcaatcatcgccaacgatggcgttctgcaaaccaatgccgtcaatgccaagaagctcgcacacaacgccacaacgctgacccgcgatctgctgctggcgacgaccggcgtgctcccccaggaactgcagggcgatgagcagacgggtgacccttcatactcgccgtccgaaacacaaatgccaaccgaatcgccgcagccacccacctccccgagcaccgattccagcacccatggcacgacatcagatgatgcgaagtcacacaacgacagcggcacagccaacgaactcgcatctccctcggcgcagccctccaacacctccagaacctcgccggaacccagtccctcgccatccgccagcatgtcgacctcctccgaagatgcggggacaggcaagcgcaaacagaaggagtccggctcgtccgcatcctctcaatccgaaggaaacgggtcgaacacgacgaaatccaacgggacgaaatcgggcaatgtcatgtgatcgacccgatttgcagacgaatgtcagagggggctttcatgtgtgttcacatgaaagccccctctgacattcgtctggcgtgttattcgccggcttcctcagcaatcaccgtctcactggtgcacatcgagtcaatctgctctgcgtcctcgtcctcgcaaacctctttggcagcggatcgctccacagtagaatccgcttccggttcctcaccggaaaaatcctgcggcgacactgacccgataccgaacgagctggtatcgggcatgtcgtcgtccatatcgagtgccttctgtttgagccctgccaaagattccgcatcaacctcatccaggctttcgagcaattcctcgtccttgcgctcgtcacgcccatgctgggccaccacatcgatatgcagatcgtcataggcgggctttgtctgcacccacatacgacttggctcaggcggacgaatctcggaatgctctccgcacccatgatccaccgagaccactttcccgtcatccgggctccaacggtttgcacacacaccaaacattgttttgaggctgccggcgagcggaatgaagaaaccacaggtcgagcacagattgccatcggcggttttcgtggagagcgacttggggccatgaggaccttcataccagcgttgcgccgtctgcgtctgccccaattccgaaagcacgtgacgcctcgacaggtcgagttcctccactgcttccaccacatcttcaacggcagtcaacgcgtcggcttgctcatcgggggatcctccctcttgagcctgcacggtctcgacagcctgctgctcggcattgagttcctctgtgcggctgaccgcctcgtcaatgccgataccatcatcaagccgttcatcatcctccggagtgccgatggaatcggtcacggagaggtcactgggaagcagacgatccttccaaggcacccatttcggtggcagaagggccttgtccgtagggatcagcgaggattcgtcgatggtccaatggtcgagctcgacatcgtggtacagcgtgaccgaccactgccagccctcatatcccttcatgagcgcctcgaaacggaaatccgtcacgccatcgtcatgggcctcgctggtgacgaactctccgacatcctccggttcatgcgcggtgtcgattgcctccgccctcgccaaggcaatgggatcgaattcacttgttgccatatcagtcctgtacatcgaagtcatcggccacggcacgcagcaatgtggccagctttcggctatccgcagacgacgggtagcggtggcgtcgcaaaccattgccggcggagtcgaggagcttgatgagatcctccacaatggcggccatgtcatccggtttcggcctggtggctttcaccaatgatggcgccgaggcgaccatggtgacccccatggcgacctgcccacggttaccctcgatcaccgaatactcgactttcgcgccttttctcgggttcctcactccctgcggcaatgcggtctggggcaggaagacatccttgccgtcatcgcctgcaatgaatccatagcctttcttcgcgtcaaaccaacgaatgcgtccgctgggcatgttcacctctatcgtctcgaatacgtgcggccccgccgcataccaaaagtccattctaccgccagcgcgcatcgctggcaaaaccattgcaagcttacgcggggcctcacctaacaaccaaggtcctccgtctgctattccgacgcaggctccttggagccttcggcgaacgccaacacatcaatccgtgccggactccatgggcaggataatcgtgaaagtcaagccactgccctcggtcggactggcatagatacgacctccgtgtgcgttcacgatcgacaatgcgatggcaagcccgagtccggtgccgcccttctgacgatccctggacggatcggcggtgtagaagcgttcgaatatgttgtgaagcgatttctcgggtacgccgggtccgtggtcgcgcagcacagccaccgcatacatgctcaggagtttgctggatttgcttttgcgagctccctgcagaagtgtttcgagcatgtcgccgtcctgtggcatcgccgcgaggtcctctggtgtgcggctcgactctatgacgcccagaccaatgtcgacaggcgaatccgaaggagtgtaccggtggatgttgcccacgatattcgtgatcacctgatggagtcgggtggcgtcgccggtcaatgcgatcttcggcaacggccctggagtctcactcagcttcggcttcctcggcgcactcagatcgatgtcgagttgcatggtggtgatttcacgatccggatcgagtgcgtgaaggtcatctacggaatcctgcatcaccgaggtgaaatcaacacgttgattcatcgagacgccgcgcccctcatccaaacgggccaatgagagcagatcctcgaccagcaccgtcatgcgcgagctcgatgactcgatatgagagatggcatcatccgcccgctccaacgtccccggcgcatcccgttgcatcttgtacagttcggcatagccatgaatggcggcgaggggtgtgcgcaactcgtggctggcgtcggagacgaattggcgcatcttctgcgtcacggcctcctgctcatggaaactccgctcgatttgcgtgagcatgctgttgagcgatcttgccagcgagcctatctccgtggattcaccgctttccggcacacgttgggaaagatcgccggcggcaatcttcgcggcggtcttctctattcgtttgagcgggctcaaggttcgctgcaccaccaatgcacccaaggaaccgccaagtagcaccacggctatgctcaccatgatgcagaaccgggtcaatgtgctgatcacatcgatctggtcacccagcgagaggcctatatacacgatgccgagatcctggaactcccccttgcccgatttcgtcagacccttgagggccacaacacgccaggggcattcagcgaactgcatggtggcatggtcgggaacccccacaacgttcttcgtattcaccacagcaggcgtggtgaacggcacaccgagctcatggccgtccaacgaaccgttatcgggcagcttggggctcgagatcacgccatccttaagcaccggctgcaacatcaccgccgatgaaccggtgttggtgttgtacaccttcacataatagctggtgaaaccgttctgggtattcacgtccgtattgagcatctgggggaacaccaggtccgcctgttccagcagctgctggtccacacgctccatcgggtagctgctcaccagccagcgtatggagaaggtgatgacaatggtgccgattgaaagcatgcccacaatgatcgacatgaggcgcacgctcagcggaatgcactcattgagcgcggcaagacgtcgtgatctgtgggtgtgcggctgattctgcgaggattgccctttcctggcatcggctgcggccacctgggccaacggcgtgtctttcaccgctgatttcggggggggtaacgccgaatgatctccgcccggtccctgtggctgttgccccatgtcccctcgcctacttctgtgccttcggtgcacggatcatgtacccgatgccgcgcttcgtctcgatgagcggtgtcaccttgtgcgtggaaccatcctcatcggtcaccgtgacatcatccaccttcttgcgcaggtatgagatgtacgattccacgattgcggcgtcgccgccccaatcgtattgccatacatggtcgagaatctgcgctttcgagagcacacggccctcgttgtccatgaggtagcgcaacaacttgtactcggtggggctcagatctatggtctggccggcacgggtcacatcatgcgaatcctcgttgatttccagatcgccgacgcgaatgatcgggtcatcctccacctgctcacgggtgcggcgtaggatggcgcggattcgggcgaccacctcctcaaggctgaagggcttggtcacgtagtcgtcaccgcccaccgtcaggcccatcaccttatcctgggtgtcatctcgggcggtgaggaacagcaccggagccgtgatgccctcctggcgaatgcgtcgagtgacggtgaatccgtcgatatcgggcaacatcacgtcgagtatgatcatgtctggcttcgtgcgactgatcacctcgatggcttcggagccggatgccgccgtctccacctcatagccggcgaaatgcagcgatgcgacgagcaattcgcgaatggagggttcgtcatcgacaaccacgattgttgcttcagttgctttactcatggcacctataatcacgcaacactctggaagttttctgaatgctctctgaaaacttaattcgggcgtttgaatcgttcgtcatcatgcggtgccgcagcatggcgcccgcgacgcggggcaggcattccagacgcttcggaggtcgggttcggctcttgcgcctctttgccttcgggttgctcggatgtctcttccggggccatggcggtgacatcaaggtcatcatcggcgttgtccaactgcatggcgtcgtcgttccgcgtcttcccaacctcctcggtctgcttggagccttcgctcacttcacgcttacggcgcatgaagatcatgaccagcacgacaacgatgagcacgacaaacacaatgatcatgacgatgatgctcaccgagctcacggcatgggtggtggcggtcgatttcgcgctggcaatggcatccatcatgtcgatggcggattgggaccagttcggcccctgaccggcctgctgatcgagcagcggtttgctcgcggcctccgaaagctggtccacggtgctttggctgcgaagccattcgtcggaattcggtgagaccacgacgacgagattgccatcatgggaggccaccgcaagcatgacggtgttggctggagggttgagcgactccaacagttgagaggcccattgttccggcttctctgtggtattgaacgattcgaggtagagcagacgcaccgtcacgcccgtctcctgcttcgtccgattcgccgcatcgatcaccttggtgagattgtcgccaagcaggttctgcggatcggtgatgtacccctgagagtcctccaccaaggcactcggactcgacgattcgctggcagacggcgacggagaatcatctgccgcagccatttgggcaccagtggcgcctacgaggagcgccgcgaacaacataatgacggagagaaccgccgtccagacgcgggcctgccgcttgaggcccccgaagttatccacaatgaccggatcgtcaccacgtcctccgaccacaattgcctgttgcgctgtccattcgttgttgttcgccataaagtcaacagtagcgggagagctgcacgttgtcccgcggtttttattacaacgaacacgatgcaaaggagcatgcaatgtcacaataccaagtcgattctgaacgcatcgccgcctcgagcgcggccgtctgctcatctatcaccgccatccgcgatgcggtcaccaccatgtatgcgaacctgaatgccctgcaggatgcatggcgcggagccgccgcggcgcagttcaacatggttgcctccgaatggcgtcgcacccagcagcaaatggagctatcgctcgaggccatgcagcaggccctgacgcaagcctccaccgtttatgcggatgccgagatgcaggcgacacggctgttcgcgacatcgtgaggtcgcatcgagctgcgcgagcgggaaggaatacatagaaaatacatagaaaagaggtggggcgttccgcagatcgatctgcggaacgccccacctcttttctatgtatgtcccggaacggaaccggaaagaccctaaatcagtaacccatgtcctggccggcggccggtgccgctgccggctccggcttgttggcgacaaccgcttcggtcgtcaggaacagacccgcgatggaggccgcattctgcaaagcagaacgagtcaccttgacaggatcggtcacaccggcggccatgagatcctcataggtgtcggttgccgcattgaagccctcaccctcaggcagggaacgaaccttgtcgatcaccacggcgccagagagacctgcattttcggcgatctgcttaatcggagcctcgatgcccgagaagacgattgcggcaccggtggcctcgtcgccttcaaggttgaagtccttctcaaccttttcggcagcctgcaccagtgcgacgccgccgcccggaaccagaccctcttcgatggcggccttggcgttgcgcacggcatcttcaatgcggtgcttgcgctccttggcctcgacctcggtggctgcgccgaccttgatgacggcgacgccacctgccagcttagccaaacgctcctgcagcttctcacgatcgtaatcggaatcggtcttctcgatctcggcgcgaatctgggcgacgcgtgcggccacgtcctccttggagccgccaccggacacgatggtggtctcatccttggagacaatgaccttcttggcggtgccgaacacggacaggtcgatggaatcgagcttgaggcccagatcctccgagacgacctgaccgccggtcagaatcgccatatcctgcagcatggccttgcggcggtcaccgaagcccggagccttgacggcgcaggacttgaaggtgccacggatgttgttgagaatcagcgtgggcagtgcctcgccatcgacatcctcggccacgatcagcaacggcttgccggtcttcatcaccagttcggcgatgtggaccacatcctgctgcgaggagaccttgctcgaggtgagcagaatgtacgggtcgtcgagcacggccgtctggtcttccgcattggtgacgaagtagggggaaatataacccttgtcgaagcgcatgccctcggtgaaatcgagatcgaggccgaagcggttgttgtcttcgacggtgacgacgccatcctgtccgaccttgtcgagagcctcggcgatcttctcgcccacctcggggtcacctgcggaaatcgttgcggttgcagcaatctgttccttggtctccaccggcttcgcggaagcgacaagctgcttgacgagagcgtcggaagccttctcgatgccgcggcgcagggcaatcggattggatccggccaccacgttcttcagaccctcatgcacgagggactgtgcaagtacagttgcggtggtggtgccatcgccggcgacatcatcggtgcgcttggccacttccttcaccagttcggcaccaatgcgctcgaacggatcctcaagatcgatctccttggcgatcgaaacgccatcgttggtgatggtcggcgcgccataggtcttgtcaagcacgacgttgcggcccttgggaccaagcgtcaccttgacggtatcggccagcttatccagaccggcgagcataccctgacgagcttcctcatcgtattcaatgatctttgccattgttcctccacgagaaattcatgcttacccacttgggtccgagacgggcgtcagctcccgcacccgttcccgaagtgctacagggcagattagcactctcagtggtcgagtgccaacttttcggaccgccttttgcgctatgggctagatgacggcgtttcgggaatatcggggcagagcctcgcgcagatatcgtgaacgaactccataaccgttcaggaacgatgaatcttgaccaccctcgtggcaagttcacccttgtcagtgggcttgctgtcgtactccaccaaatccccctggcgaagcgccttgaaaccctcggcctcgatggaggaataatgtacgaacacatccgccccaccatcctcgggagtaatgaacccgtacccgcgacctacattgaagaatttaaccgttccccttggcatacccttgtatcttccttcgtgaaggactccgtgaaggcgaacgactcatgagaggaacgcaacgcaaacttccccgatttgcggcccggaaccattcaccctttccccatgatagttatgagggggtattaacgcagcttcggcgtttcaaaccggttcttatataagaaaaataccgcagaacgcgcatctgcctaaccgacaatacaactttactgattttacaaagtccaaattggcataagaaaaccggccctcgggccggttcgtcgcggaagaactccgtcggcatgcgacgcaggcgactcaattcatgagtacgacggccactggcactgcaatgccctcggctttctgcacggtgctcaccccaagggtttctgccaccttttgcgcagtggccagatcagcgtcgttctgataccacaccacgctttgggagggaagctgcatgccgttcggattgctaggcgccacgttcgtgaagccagcgccctgcaaccgctgcgcctcctgggcggcgtatccattggtggcagtgccattgatcacactgatcgaagcatcgagattgactttctgctcgggcgtctgctcttcgctcgggctctgagacggcgactcactggactgcgatggcgactgcgacggcgactgcgacggcgattccgacgcagaggcgctggcactctgtgagggggattcgctctcactggcactcgtcgacgacggcgaggtggtcgtggttgtactgctggatgccaccacggtctctcgatcgccatgtttgaacatgttcgcagcctccccggagaacgcgctccagaacaacacaccaacggcggcggccacgacaatcacgatcgcatagggggtcagacgcactggccaggaacgacggccattgtggacgccgaccgggccggtcggcggattgtcgaaggaatccttcggatacgactcatacttatggtcatcgttgcgagccatggccgtccctttccgtacgcagtgcaaacaagtgtcggctccaatataccaagtcggggtataccaggtcggagtcacaagggccaccgcacacgaataccggcggcagacgtccacgcgctacggtccatagccgcaagaagcctggagttgcacgagcgggctagagtggagacatgaccgaaatcaaacctcttgaggaactcatggatccggggtgggccgaggcgctgcgcccggtggagccgcaaattcgccatatggggcgtctgttgcgtgaacgtatcgggcatggcgaacatatcgcccccgccagccggaacatactgcgcgccttcaccattcccttcgactccatccgtgtgctcatcgtgggccaagacccctatcccactccaggctacgcagtgggattgagcttctcggtggcgccaaacgtccacccgctgccgaagagccttgtcaacatattcaaagagcttgaagatgatctgcacgtgccgccaccctgcaacggcgacctcactccttggacccaccggggggtggaattgctcaaccgctgcctcaccgtcgagattggcaggccgaacagccaccagaacttgggctgggaacctgtgaccgattgcgctgtgcgtgcactcaacaaccgtgtcgatgagcacggcaagccaaagccgctggcagcgattctctgggggcgtaacgcccagaccttggagccgttgctgacgaatgccgccatcatcaaatccgcacaccccagcccgctgtcggcatcgcgcggtttcttcggatcacatcccttctcccgcgcgaacgcagcactcaagcagatgggagccgaaccggtcgactggtcgctgccatcgtccgattgccctgcacggtaatagctggaggcacatgaagacgagcacactgcacggctgcgtcgaatgcccattgcacggccatgcattacactaaccaactgaaacagaacagcatacgaaacgctcaaacatagtaggtggcacatgtctttcttttccccctcccaaccgaccgcgcctccgccagtcccatccaccctccagtccccaaccgtcccgatctcaagaaacgatgcggaacgggccggtcggttggtcgacagcatccgctcgcgattcgcgcaaacgcttgtcggccagaccaatctgcgagaatccctgatcaccaccttggtggccggcggccatattctcatagaatcggtgcccggcctggcgaagacgacagccgcacagacgctggccacctccgtctccggttcgttcaaacgcgtgcaatgcacgccggacctcatgccttcggaccttgtgggaacccaggtgttcgatttctccacccaacgcttcaccacgcaaatcggaccgatccacgccaatttcgtgttgctcgacgaaatcaaccgagccaatgcgaaaacccagtccgccatgctggaggccatggccgaaggcgccaccaccatcggaggccaacgaatcgaacttcccaagccgttcatggtgatcgccactcagaaccccatcgaagaggagggcacattcaatctgcctgaggcgcagatggatcgcttcatgatgaaggcgatcatgacctaccccagcgctgacgaggaacagcgcatgctggggctgctgatcaaccgtggatcggacgccatcgacccgacgaagctcccccgcgacgtcatctcgattcaggatgtcgactggctgcgcgaaaccgcgcgccgggtgcatgtctccgatgcgatcatgcaatatgcggttgcgctctccgagacctctcgtggcggcggcccgaagcccatccaaggcctgtcctccctggtgcgcctgggtgcctcgccacgcgcctcgattgcattggtgcgcattgcacaggcttcggcattgatggccggcagggattatgtgattccggaggatgtgaggggcttcgcgcacgaagtgttccgtcaccgcatcctgctcacgttcgaggcgctcgccgatggcgtgaccagcgatcagattgtcgaccagattgttcaggtggtgcccgttccatgatcggcaccaatcatgatgccaatcggtcggatccgatccgacgcaagatcgagatgctcggcacgtcgctgagcctgcccaccgtgcgccgtgccatgggcatccttgagggggagcatgcttccgcacgacgtggaggcaatgacgatctgctggacattcgtgcctatgaggtgggcgatgaggcgcgacagatcgattggaagatcagcgcgcgcaatggcagggcaatgattgcgcagcgcgagcgtctctccagcacccgtgtgtacctgttgctggacgcaggcgtggagatgaccgaggtgtgcccttcggacgagatggcgtatcgcatcgcagcgaatgccttgtgcatgttcgcggcgctgagcctgcgacgcagcgatgaggtgtcgctcgtcttcggtgactcctcgaatatcacccgggtgccgttccatggcggtttggcccagttcgagcacacactcgacaaggcgcttgaccgaggctggcgattcccgcgcaatatcgacgcactgctcgactatgccgcgcatattcgcgaccgtgaggcgctcattgtgctcgccaccgacgatcatgccctcgacgacacgcatatgcgcgcaatccggcggatcacacagacgcatccgctggtgctgatcaatgtgggcacgatcaacccgttctcgagcgatcccattccctcgaggccgcatgcatcccttgtcgatggcgcgaccgaccggaggattcccgcgttcctgcgcaacacgaaagcggcgcaggagttggacacccatagggcctacctgttgcaggcgcttgaccgggaactgttgcgctgtggatcacgtatgattcacgcctcgtcgagcgaggggatgttccacgcattcgtgcggcttctctccctttcccatgcatcggtcttcacgcccgtcacgattcccgaaggaactgcgaacgcataaatgattgtggcaatagacacccagaacctccatccgcgcggaaccatcgccatcacgcaatcgctctggattgcactgatctgcgacatcgtgctggcgttgatcctcattgtggcatgctgcgtactgtcaggcactcgacgtcgcccggaaaccaccggatcgcaagatgaagagactcttcccaagaaggagtgggccgcgcgggtgaaccaggtggtcgctcggcatgacgctcaggacatcacgcgagacgaggccttcgcgcagctggccgcgattgcgcgcgatttcgcatcgaatatgtcgggacgacgcatgcaggcgaacacgttgactgatctacgccgtctgcgccgcaccggcgtcgccgtcaactgggatttgctccgacagacgatcgccgcgctgtatccgccggagttcgcgcaagccgagcatccacaggcgcgtggcgtcagcgtgaggcaggcggccgactgggtgctcgacctgattgagaggtggcaatgatgcttcgttggcaatggccgtgggcattggtggccgcattgctgatcgccgccctggtatgcctgacgatcgtcatggtatcgtcacatcggcgcgcctaccacgatgaagcgagaatctacggtgtacaggatgatcttgagaccgagcatgccggtgcgctgatgcgcgtctggcgccgtctgaaccgcatcgccgtggcattgctcgcttgtgcgcttgtcctctcctgcattctcgtaggcaggcctgcgcatgtggatgcacaggacgagcaatcatcgaaccgcgacatcatcctgtgtctcgacgtctcaggatccacgcttccctacgatcatcaggtactttccacgtatttgaatctgctgcagcatttcaagggtgagcgcataggcctgagcatcttcaactcatcgtcgcgtacggtgttcccgctcaccgatgactacgcgatggtgaccgagcaactcacgcaggcgaacgacatgctcaaaggcgtgcagacccaggacgatatcgataagatgagcgacgaacaataccagcagattgccgactggcttgagggcacacagaaccgcaagaacgccacttcactcatcggagatggattggtgggctgtgccgcaatgcttcccggattcgcctattcgaaggccgacactgcgcaatctcggtcgcgggaggcgtcgattgtgctggccaccgacaatgtggtctcgggctcccccacctattcgttggctcaggcgcttgatctcacctcccaagccggcatcaatgtggacggtctgtattcgggaccgcaatccagtgagggtgacgccacgaccaacgagatgcgccaactcatcgagcggcatggcggtctgttcctcacccagtcgaacagcgcgtcgatcgatgaattggtgcgtgagatagacggtcgtcgttcacatgaggcacaggcccaatcacagactgccctgacggacgtcccgggatggtggactctcgctgtggcgattctgcttgcgggctggttggttatggcgtggaggttgaagcgatgagtacgttcggctttgcaccggccctcggctggattggcggctcccttgtggctgcggtgatggtggcatgcgcggtgacgtgtgtcgtgctgcatgcacgtcgcggcgccgatggtaccgatgagacactctggtcgtgcgtaaggcgtgtgctggcatgcgtcatcgtggcgctcatggccttcacaccaagcatggtgaccaagaccaccagccgtgccatcagtaccactgatgtggtcattgtctcggacatcacgccgtcgatgggtgtgcaggatgcccgctatggctccaagtccgacctttcccgcctcgaagcggcgaagtccgccattgcagacatcgtcagggattacccgaattcgagtttctccgcagtatccgttggagcatcgggagcggtggatgtgccgctgacgcccgacacccgtgccatcacgaattgggcgcagtcccttgataccgaggattcctcgagttccagcggttcatcgcttgatgtggtgatcgatccgttgctgcgtgcactcaaatcgattcgcgacgcccacccggacgatcgcattgtgttgtacatcatcacggatggggaacagactgtgcggaacacacgccgcacattttcgtcgctgcgccactatattgacgatgcctgcgtgatcggcgtcggctccaccaccggtggccggataccttcgaagaccgcaggtcaatgggtcaccgatccctctacgggccagcccggcgtatcgatcatggatgaaggacagattcggtcgctggccgacgagctcagtggcaaagtggtgatcacctcggcgaacgacacggtggcgagcgcacagatcgcgcaacaggccgggagctggcgtgaagacgacacgcagaaggagcgtacgcgcatcaatccgattgtctggccactggccattgcattggctgcgttgctggcatgggagctgggcacatggatcgccacttcgaggaggcttctatgagcgggaacatatccgggcgcctggatcgcgccacggcgagcaggtctttcacgaaacgcgcgcctctcggcgtgcgcatcatgcttgcggcattcgccgtcctggccattgcattcgccgtattggccggcgtgaacatcgacgcacaacgtcagtatgatgccgcgactcaaacgctcaccgagaatctcgagaccgcgtcccgcaacgacgccgatctcaagcaactgctgacctcacagcaggagctggacgcacgattcgccagtatcaccggaaaatcggcggtgctgctgccgcagatcagcgagagcaccacttataacgcgcaggtttcgaaacagctgaccgacttggtgcaacaacaggtcgacgccgatgccgcgaagaacgacagccagcagtcggggcagcacggcgagcagcccaaatcactcgactcgctcaccgaggaacagcgcaagcaagtggaggagttgctacgcagcaacgaggagctgggcaaatccgaggattccacgaacgaatcgaatggcggccaaggcgagagggaaaacgacagcccctctcgcccgtcgaatgtgaaaccgtggtaagccacgacggtgaatggctatgcagtgttgcactgtggatagtttccggagtcaatgcattcacgccgttcactgaccacaatcgccgattcagctggattcatggtcgactgcggtgtgcaatggaatcatgatcggctccaattcagcgttcaacgccacgtcgggcaccacgacgcagtgcgtatgcgcgggcaatgcacaggaatgcatcgcattgctcgtgccattggtgcgcggttcgttccatgcgcttgatggcctgatggccgcgtgccggtccgatacaggaacatggagcggccgtgccgccgaattgttccatgaacggctgcaggccatggaaccacgagcatccgcatgtatgcaaacgctgcagatgctcgacggattgctctcgacaatgtaggggctgccatgacgaagatggtgagatcatccattcatggtggcgctcagtatgccactgccacgctcgacctcgttcacggcatatgctcacggttgggggcctgcgccgccgatttgaaggcacaggccatcgccttgtcgaacgccagaatgcgtgttgccgtgctgcgcacctcaactcttcaatggtgtccggaacagaacggcatggcggcattgcgagctcccgtctgtgaatcgagtggattcggtcgttcccttcatgttcatgtcgagtaccttcgcctgacggaccacgctgaatccgccagatcacagctgcatgcgctggccgtccaatgcgagagaatcgccgatgtattggcgcgtgcatacggcctgtattccgaggccgaggccaaaagccgcatggccactaatagggcactgcaatgggccgcacgggtggcacctgcgacaatggcgaaattcaccattgcacaggctctgggcggatggctatacggtgtggtcactgagggcaatttctcagcagcccatgccttgaatgccatctcgtggcagcaggaggggctgatgcgtgcggccagcgcagccataggcctgcatgacggtcaatcaccggtgccgtcaggagcatatgccatcgggggaatctcatcgcgagcaacgaatctgattcaaggtgatgcgctgaccgtcgaatccgtggatccccatgaaccatccgtcgcccctgtgtcggacatgggcggtgcactggcgaatctgcgaaggctctcggcagcgaacgcggacagcacgcatggtgaatatgcaaccatcgccatctcacggtatgtggatgccgatggccggcgttcctggctggtgaccattccgggaaccgacggcaacttcgactcccccttgggatgggagcagaatgtggagctcatgagcgccaatgccatgcaacgacgtaacgcagacagcgcacgtatggtcgtcgaagccatgcggcaggcgggtatcggccgcgatgagcgcgtggcgttgatcggccattcgcagggcggcatcatcgcggcaacgctggccagcgattatgccgatgagtatcgcatcgaacatatcgtgaccgccggctcccccatcgccaaccatccgatgggcaaggggacatgggtgaccagcattgagatggaagacgaactggttgccgcgctggacggcgaggtgaatcctcggagcgagcagtggctcaccattcgaggtgaggtgcgcaatgtggcggacgggtcacctgccgatgcgaatggcgccgtggatgacggcaccgctgccatgaccgccgtcgatcaatcccatcaggggaaatacgaactcacgcacgacctcgcctaccataccgccgcctatgagaatgcgctgtcgctggggtccgaggcgcttgcgaaccatgacagccatttcatggcgaccattcacggcgactatatggagaccacctactggagcggccgcatggaacacggcaaacacgacatcgagatggatgacacgcacacgcagtgaaaatggacatacaccgtccatgtctcaagggcttggtttagggtggaaccatgaacctttccgagatctcaccagccatcgccctcacccctctggatgggcgctatcatgcccagaccgccgctctggtggaatacctgagcgaaccggcactgaaccgcgaacgcatgcgcgtggaagtcgaatggatgattctgctcgccaacggcttcgccggaaacgactggaagccgattgtcaccggcgtcaagccgctcaccgaacaggaacaggcattcctgcgttccatccccgaggagttcggggcacagggcattgccaggcatgccgcgcatgaagccgttacgcaccatgatgtgaaggctgtcgaatactacatcgacgactatctggatagcgcggagcaggtgctcggtgcccccacccagctcaccgacctgaaaactctcgtgcatttcgcctgcaccagcgaggacatcaacaacctctccatcgcccgctgcgtgaagaatgcaatcgaacacgtatggctaccgggcgcggatgccattgtcgacctgctggctcagcgtgccgaggagttcaaggacatgccgttgctctccctcacgcacgggcagccggccacaccgaccacactcggcaaggagctcgccgtctacgtgtaccggcttgggcgccagctcaagcatgttcgtgagcaggaatacctgggcaagatcaatggcgccaccggcactttcggtgcgcatctggccgcattgccgaatgtcgactgggtcgccgtctcacgtgaattcgtggagaaccgcatgggcctgacctggaacccgctcaccacccagatcgaatcgcatgactggcaggcggagctgttcgacacgatctcgcacaccaatcgcatcatgcacaatctgtgtgtggacacatggatgtacatctcccgtggcgtgttcgcccaggtaccggtgaagggcgcaaccggttcgtccacgatgccccacaaggtgaacccgatccgtttcgagaacgcggaagccaacttcgaaatctcctgctcgctgctcgacacgttggcagccacgcttgtggagtcccgttggcagcgcgatctgaccgactccaccacgcaacgcaacatcggctcagcattggggtattcggtgctggcgcacaacaacctgctcggtggcctcaagtcggttcatccgaacacacaggtgatggatcgcgagctcgatgagaactgggaggtgctgggcgagccaatccagaccgccatgcgcgcccaggagctggccggccgctccggcatggaacgcccctacgagaaggtgaaggagctcatgcgcggccactccatctcgcaggccgatgtcgagagcttcatcgattcgcttgacttcgacgacgagaccgcagcccgtctcaaggctttgacgccggccacctatgtgggccttgcatcgatgctggtcggttacgatcgcccgtagtcctttttcaatccatcgcgtagaatatacgtgctgatgtgcgatgctcatgcttgggccttccacccgggcatgggcattctatatgaaggactgatatgacaacgcccaattcgtccggctcaggtcgggtgccctccgatcagacggatgtgcaacaaccgtccatcgagaagacccccgagcatgcactggcaagtaggttccccaacgtgaaggtcagcgatgtggcaccgaagcgcaaccacgtgaccagcgatctgctgcacgcaggtgcggctctcgtattcgggattctggtgatcctggtcgccgtctaccttcatgggctcaccaccggcgtcgaagatgacgcccattccgccagtcaggcattcgactggctggtcgacctgccatcgtcgttgctacaacagctcattgtgatttccatcgtggtaggggtgctcatccaattggtgctcaaccgggaatggcttcagtccgcttgctcggtcggcgcgctgctcatcggcttccttgtctgctggggtgtctccgaactgctctcctaccacagcagcgccatgctcatcaacacattgctgtcgagcggcacccgcgtagggccttccctgctgcccgatttctacgccgccatagctgcattcctcacggtcgcaggtccccgtgacacccggtcatcggtgaagtggagctggaatatactcctcgccggcgccgtgatcttcatcatgacctcgtggagctcgttgcctggtgtgctggtggccatttgcatcggtcgcatggtgggactgtccatccgtttcggcgtgggcacgaagaactcgggagcatggggatatcagatcgtgcaggcgctgagctccatcggcttgcatccggccgtccttgaccgacgccccgaggcatccgaccatgcacccatgcttacggacgacctgaccgaccattcccgactctacgatctgactgatgagagcggcgtgcactatgtggtgtcggtgcttgacaaccaagtgcagatcaccggctatttctcacagctgtggcagctcattcggctcaacggcgtcgcggtgcgccatgatcgctccgccgtgagcgccacgcaccaccactattccatgctgctggggctgcgtgacatagatctgacctgtgcaaggccctatggtgtctgcgactacggtgaatcctctatagtcgtgttcgagcaccgcgagaccattcacgccgtggattgcagggagctcgacgataccgaagcgctctcgctcatgaactatctgcagcgtgcgcatcagcgtggcttcactcaccgccagatcacggcggacaccattgcgcgctccgccattggcgacatggtgattgccggctggcagaatggcgattacgcgtccaccaccacgaacatcacactcgacaaagtacagctgctcaccttgttcagcacgatgctcggcattgaacgcaccgtctcgctcgcgcgccgtgcctggggcgaatcgacactcatctcgttgattccgtttgttcagaaggccgccgtccctgccgccacccggcagatggaaggctggaacaagcagattgtcgaggatctgcgcaccgcactcagtaaactggcccctgaagaagtggcggaatcgatggagcaggtgacgctcacgcgattcaatgcgcgatcgttcttcggtcttgtgttgctggtgatcgccgtctacgtgatgctgacgcagatgcggccggacgagatgattcgcgccgtgaagcaggcgaatctctggtgggcattcgttgtcatgctgttcggcttcctcgcatgggtgggttcggccatggccctcggcgccttcatggacagggaccgccgccggcctttcggtttgctctgctcgcagattgccgccggattcactgcggtgtcgatgcctgccggcatcggcccggcctttgtgaacctccagtacctgcgcaagagcggctaccgcaatacgaccgccactgccatcatgagcgccgtgctcgccgtgcagggggtgatcacggtggtcctgctgctgctcattggcattttcaccggccgtaacaccctttccggcatgattcccacgaacacgctgattatcgctatcgcggtcgtcgccctggcgatcagcgtgatcatggcgatcccctcggtgcgcaggaagatcgccaacaagtatcttcccctggtgaagtcatatgccagatcgttgttggaaacgctcacgcagccgcgtaagctgctcggttcggtggccggctcactcattctgaatctctccacaggcttcggcttctgggcggcgctcatggcgttcggattcaacatgaaccccatcgagacgacgttcatcttcctgctggcgaatacacttggttcagcggtgcccacaccgggtggcctcggtgccgtcgaggccgcgctgtcggtggcgttcagcgccgtcggggtccccgccgcattggcgttatcagccacattgctctatcgtgtcgtgttctactggttgcgtattccgctgggtgcgttggctatgaagtggctggataagcacaatctgatctgatttatttcattttgtaagcttttgatgcccagaacgtagccaaatgcgaaaaaatcaagggaaatcgttgcaaacacgcggatttgaccgaatcttgaggtaagatgcttcttgaacatgtggttatccgcaatgaggattacccctgacaaagaaggacgcttctatggcatacaataagtctgatctcgttgcaaagatctcccagaagtccggtctcaccaaggctcaggctgaggctgccgtcaatgctttccgcgatgtcttcatcgaagccatgaagaacggcgaaggcctcaagctcaccggtctgctctccgcagagcgcgtcaagcgcgccgcccgcacaggccgcaatccccgtaccggtgagaccattgagatcccggccacctatggtgttcgcatctccgctggctccctgctgaagaaggcagtgagcgagtgattcgcagcctacgctagaaaatgacccggccagtgacggccgggttttttcatgtcagattgcttcggcacccatgctcagacgggcgcttcatcgccatccgcgcgcgcatcacccaattcgcccatgagcttgtcatattgcttggtcggctcgtcatggaacggatcgagcagcaccgcctccatatgcaccggacgcacaagcttcagcgtcgtccaatcgcagtcgtagacggcatcggtgtgcgatgccgccgccacgaaacgtccacgcagcacggcacgcgtgtgagggggcggagtggacacggcatcgtgaatctgatcggcatccaccaaggtgcgcatcaagccatgcgcgcataacgacgggtagagcctgccgttggcgatgtcgtgatagtccaggtcgagctggcgcaatctggccggtgtgacggtgccccgagactgcaaacgattgaagaacacctgcttggatgcccaatcgaccacgtgcgacagcgtctcgatgtcattggccgccaatctgtcgagtacccatcgccattggcccacaatccattcgacattgcacaacgcgtcataccgcaacgatgcctccaatgcatcaccgtgatgtgcggcgaaggactcgacctgctccagcatcatctgctgcagttccagtgcggtggtcgaacgccccgctgccagcgcgatgcgggcatgcgccccatcggtgttgatggcgtggtttgcagcgatcggatccgcgagcgcgaatgcctcaagctcggtctcgcagccgctgcgcgctgcatgctccatcatgcacagaacgagatgcgtggtggcgcatttcataagggtggcccactgggagcgattggagtcgcctatgatcacatggagacgccggtagtcgtcggggttggcgtgcggctcgtcacgggtgttgatcatcgggcgcgaccgtgtggtggcgctggagacggtctcgtccacgaatgccgcacgttgggtgaacaggagccgttctccgtcgaatctgccggctccggtgtagatctgccgggtgatgaggaatggcagcaacacatgctgtatcatgtccagattcacgaaacggcgcacgaggtagttctcgtggcaaccgaatgaatgaccggcactgtcggcgttgttcttgtacagatgcagggtcgcatgccgattctgcgcgtcggattcccgcagcctccgctgggcgtcaagccccatcgaacgcatggtctgctcgcctgccagatcgctcagcaacgcatccgaggggcatatcgcctcggcggtcgcatactccgggtgggatcccacatcgaggtacagacgtgagccgttctccacgtaggtgttggtggaacgggccctgcgcacaacgggctggaacatcgtcatcgccacatgactggcgtccatgggctccggaatatcggtgacgctcacaccatactcggtctcgatgccgaagatgcgcgcgaaatcatgctgatgcgtctggtccgacggctgtatcgccctgctgccactgtcgtgcagctgtggcatcactcgccgcctttctgcacgaagctgctcacatattcctcagcgttcgtctcgagaacggtttcgatgtcatcgagaatcgcatcgagatcgtcagcctgctcctgcgcaagcatggccgctgcggaaagaccctgggccgtttcctgggtctggtcgtcatcatgccgctgtgtctcggcggggatctgatggtgtccggatgcagatggcattgctcccccaatctggtgtggattccaatatcgatgtcggatgtgccctgtgccacatgggctgttcaaagtggctcaggatttgaaatcactgttgtcccgcgggcttctgttcgtgatgatggtaggattccccacaatcagagttgatgaggtagggttgcagctcctgtatgatctgtccgttggtggccacgagatcgttctggctacgccagtggatgagcccgccctcccatgtgctcagctgcccttgggcctcccagagcaccacggcggcggccgagatggccggcacatcacgttcatgcagatgcggttcgaagtacgcgtcgtaggtgccatcggccaccttgcacacatcgagcgagacgggcccgatccgtttgatgtcggcgggcttgccggcgaggctcgcgaccacattgagggcatgttgtgcctcctgcggcacatacgacatgccgaagctcacgattgagccatcgaggtggctgactgtggatggcatgatcttctcgcgcttctcccccactggtgtcttgcgcatgcggatcgcgccctgctgccgggcggccaaataggtgaggttcagtgccggcgcatgaatcacccccagaatcggctgggccgatccgaactcattgaattcgaacagcgagatggtcacgctccattcggccatgctgcgcgaatagttgatcacgccatcgacaccgcccacgcaccagtaccggtcaccgggcgcccattcgtcggtgcgatcctcccaacggcctttgaacggatcgatgtaggtgagacgattgtagatgaactgcgacagacggtcgtccaccttgagcccgcgtgagtagtcacgctgcaccgtgttcagcgtcaccagatccttcggcatgagctggtccttgagcgcatgcttgccggcgtcctcggcgatgcgactcacctgcactgcgagctcccgtaatccggcctgcataccaatgcctcctgtgaccttatgtctcggaaaaatctgttccaagactagcaaataatctgtgagtattctgaaaaactcgccctatgcgagcgcgctggatacagcggatgtacgacctacgaatgttcgcagatgccgccgagactcctgatgagctgcgccgcgctggacgcctcctccacctgccgttcggtgtcatctttggtgaaccgcgtgggatcgcgcatgtcgagcgtccaggaatcaccggctccatcggcaacggtggtgattcgggtccaggagatcgcacgcaattcagtggggaatctgtgcagtatcgcggcacggaaccatgcgcgtgtgtccgccggggcatcggtcgccgccgcggctatacgctcatccgtcaccacacgctcggcacgggagcgcaccttggcgaacaccgcctcgttctcgggagcgagcgaagcccatcgcaattcgagcgcgcgcacctgtggattgtcccagcccgaggcagaggatgcgccgcaaccggcgatgcgtcggcgcatgcgttcgagcagctgccatttgagaagccattccagtcgagaggcctgcgcggtcatcgtcattcgggtgtcgtcgtcggcatggcgaacctcggccacgtcgatcagcgcctgctgccacatcgccatgaccgagcgggtctgcgaatccggccataccggctccccgagcgaatcggtgccgtacaccatcgatgccacctcgtaaacaaggccccgcagcgacacctgcagctgccacgccgtgctcgaacctccattggccaaagcgagtggttcgtcgaaggtcaggtcgtgcgacaccgtgtgcatggcggcgaccgagtcgagaagcgaaagggaacgcaactcatccgtcaggtcgtaatccaatgcagatgcctgctcggccacccaaagcagcatgcttgtcgtgccgagcttcaacacgtccggcacttccaggcggttggcatcgcccacgatcacatggagtctgcgcatctcgtcaggcgcatgcgactcgtcgcgggtgttcacgatcggcctgtcgaaagtggtttgcaaacccactttcatatggaagtaatcggcacgctgactcaactggtagcctgcccgttccccgcgctcgccgagccccacacgtccagagcccgtgtagatctgccgcgtggcgaaatggaccagcatgagcgcagtcactacatcgaagtccacatcgcgacgcagcagataattctcatggctcccccacgcagcgcccttgccatccgcattgttgcggaatacctcgaactgatgccgctcagtgctcgcggattgggcggcctgacgcataagcagatcgccggcgaaatcataggccacggcctcaaacggatcgcgcgtctccggcgcggagtattcgggatgcgcatgatccacgtacatgcgccctccattggctgcgaaggtgttcgtgatattgcgttgcggttcgtcggtaagcatgtcgggacgtgcagcggcgcggggcatcgtcataccccgcatatcgtgcaccggatcctcctgccggtagtcccaacgaatatgcctcgtctcctcatcgcctgcatgggcaatcacatcgaatgacgactgcaccgggttggcatggggatcctgccgtaccgacacggcatactcggtctccgtccccatcactctgcgcacgctcattcactccgctcctctcacgacatgttccatgccaacggcacatttcgaacacattccattccaccgagacccgctgccgggatcagacgccgtcagccgccaacgtcagcgcgttgattctgagccattgccctggatctgtctcgttgatcgtggagcggttctgttcgtattcgtcgtcaatggcctcatggatccgcgcctcggtgatgccttgcggctcatcgtccctgctcaccgacccatggaggatttcggccttcaccgccttggtcttcgcccggtcgacgatgttgcgcagcatcgcaccgctgacgatgtcggccatgtagattccacgccgacggccctgttcatcgagcgtggcaagcaatcgggattcatccctgcggaaaagatcacgcaccagcgaggccgccagcgcatccgcgtccctgccgggttcaaggggcagcgcatcggtgaggtaatgacgggtgatggccatggcggccgtctcgtccggccgtgtgacatgaatcttgacgtccagacggcccggacgcaacaccgcgggatcgatcatgtcgatgcggttcgaggcgccgatcaccatcacgtcgtcaaggctctccacgccgtcgagctcggtgaggaactgcggcacgattgtcgtctccacatcgctggagacgcccgtgcctcgggtgcgcagcagcgaatccatctcgtcgatgaacacgatgacggggcgtccggcacccgacagctccttcgcccgctcgaagattctgcggatgaggcgctcagactcgcctacgaacttgttgagcagctccggtcccttcaccgacaggaacacgccgtcgttaccactgcccgcggccagctcatgcgcgatggccttggctatgagcgtcttgccattgcccggaggcccatacagtaacacgcccttcggtgccttcaggtcgaaccggtcgaagaggtcacgatgctggaacggcaactgcacggcatcgcgaatccgtgcgatctgctcatccagacctccgatgtcggtgaaggagacatccggagtctcctcgagaagcagatcctgcgcctgttcctgcggcagtacagacaaaacataggtaccggagggatcgatcaccacacgatcgtcgacgttgatcggagttcgtgccaccgcgctcgcacgcatgaccacaccgcgattgcctccgacatcggagacgatgagcctaccgtcggcaaggctttccgagaccgcacgcatcggaccggtagtaggtgtctcgcaggaatcgacaatcaccatgttggcatcgagcaacacgccttggccgctccccaactgtgcgggattgacagtcggcgacagcgggacgatctggcgtctgttgccattgagaatctccgcgcttgcatgccgcacaccatgctcatcggtggaacagcgatgcacgcggaccatggtcgccattgtcaatggcggtgccatgaactgctcgagctgcgccttcgccttgcgaagctcctcggtggcacgggtgagcgctttggcgagcgcgtggttgcgctgccgcagctggtcgttctcatgcgccgccacagcctcgggatccctggactgcgaagccgcgtccgtgtgcttctcctgccccatacccaccttcgttcaatccgaatgttccgtatgccattgtaatgcacggccccgcaaaggaaaacgggtccgtgcaggagagcacgaacccgaactgacttcagcgcctaacgcgcatcgacagtctactcatgggattgcgtcgagcgacgttcgcgtatcagattgcgaacccaccgccacgcaaagaacaccagcatcagcgcaaacaccacgatgatcacatcttcgaacacattgagcacgccgagaatggagcaccactggtcgccgagcatgtaaccggcggtgacgagcaccgtgttccagattgccgagccgaggaaggtccagccggagaacttcgcgaagttcatctggttgaatccggccggaatcgagatgagcgagcgaacaacgggaatcacgcgtccgatgagcaccgaccaggtgccgtacttgttgaaccattcgtttgccttgttcacatccttgcggctcacgccggggatcctgtcgactgccttgtgaatgcggtggagaccgaaccagcgcgcaatgccgtacagcgcccaggcgccgagcagcgatcccattgtcgcccataggatcgcaccgaacaggctcatgctgccacgggcagcggtgaaaccggcgaggggcagaatgatctcgctgggaatgggagggaagattgactcgagggcgatggccaatgccacgcccacaccgcccacatgttccatgagagagacgagccacgccgtcatggcgccgatcaggccatcggaactcgtggcgcattgcagttgggcctcagccagggtaacagtaaagtgcatgctttgattgtcccaacgtttttcgacaatcaaaggcatgagcgcaccactttcgcaacatcttgacaacaccgacacactcgctgacccattacccgctctcggcatgccgggcctgcttgtgatggatgtcgattccacgctcatcgatgaagaggtgatcgacgaactcggcgaggaggtgggtgtgggcgacgagatcgcggccatcaccgcgcgggcgatgaacggcgagcttgatttccggcaggcattggacgaacgggtggcgctgctgagagggatgccagcacagatcttcgatcgcgtgtacgaacggttgcatttcaccaatggcgcacatgaactcatcgacacgctccatgcgcatggctggaaggtgggggtcgtctcaggtggcttccacgaaatcgtcgacaggctcgcagcagacgcgcatctcgattaccacattgcgaaccgactgggcgtggatgcccgccgcggcatgctcaccggcgaagtggtcggtgatgtcgtgaccaaggaggtcaaactctcccggctacggtcatgggctcaagagaacgacatcgcgcgcatccagacggttgccgtgggcgatggcgcgaacgatctgcccatgatcggcgctgccggactgggcatcgcattctgcgccaaacccactgtgcgcacggcggccccccacacgatcgacgagcgcgatcttcgcaaggtgcttgatttcctgcagtagcagaacaatgtccgctgccgggcaaccgcagcaattcactagaatgcccggagtcggcacctcgatgaaagccggctccgggcattctggtgagacacgtcagtcgagataggcaccttcagccagatgtgcgccgcgggcccactccggagcccccatctctcgcttgcccgcggccttgacaaccagcagttccaacgggtcggtggaagtgcccacccacacgtgatgcttggtgacgtgcagctcacccggcttgagattccgaggtgattcatcggccgtcatatcggccgggatggccttcgacacatgcagcgtctcgttggcatcatcaccatgtggatgtagattcgcccatgcccccggcgccggcgtgcaggcgcgaatctggcgatcaagcgcgaaagccggcacgtcgaaacgcatgtgggcatcctgcgtggtgatcttggcggcgacatcgtaggagcctgccggctgatcgacggcgttgacgactccttcgtcaagggcctgcagcgatgccgcaagcagaccggcgccatcttcggcgagacggtcgagcagctcgccggcattctcatgcgcacctatggtcaccgtgctctgcccgagcaccggcccacgatccatacctgcagtgatgcggaacaccgagcatccggtcacttcgtcgccagcccagatcgcgcgctgaaccggagcggcaccacgccactgcggcagcagcgagaaatgcaggttgtaccatcccagcggcagcgcctccagcaccgattcacgcaggatcttgccgtaggccaccaccgccgcacattgtgctccggtggccttcaatgcggagaggaagcattcgtcggccggatcgcattcgatgacatcgaggccaagttcacgagcggccattttcaccgggctgggcataatcttacggccgcgccccgtgggcgcgtcaggccgggtgagcactgcgaccacttcgaaatgctcggtgtctttggccaacatacgcaaagagggaaccgccacctccggggttcccgcgaacagcactcgtaacattgatgtcctctcttccgcccgtgcaactcatgggctgtggttttcactgaatcccaagcatagtacgcacaaggcgcaggcagtcggcttacggtcacagctgagtcggatgccgcctcacagcagatctttcgggtccattctgaaccgcagttccccactttcgcgagaggccacgtgacgcgccacctcagtgcgcagccgcaatgcgagttcggcacgtcgggcatgcgagacgcgcacgaccgccttcaccctatcgcccatctcatcgagttcacgggcatcgatcgtgcgatctggagcgagaggggtgatgccgagcagtgaggggaccttcccttctccgctttccacccatgcccaatctccgttcgcaatgcctatgttgtgcagggcacgttccaccgcatcacgtctcccccaaatgcaggcggcactgacgattgggggcagccccgtcgcaatgcggtccgcgagctcattgctcgcaaccacgcggggatcccagagcatgagcgaacgagccagagtcggatacgtctcgccgatcagcagtcccctgcctccggcggcacgtgatttgcacagcgacatcgcctgcatccaattggacagcacatccacgcgagcatcgagacgcagatcgtacagactcgtccaggcatcgagaatcgccaccgcctcgtaggctcccgtcgtaccatcttgcgtatgcaccatgggttcgcatccgggagtggcgacgacaatgcgcggggcggcatccacatgatccacaaccccttggctttggctcgacacgagcatgggaacgccacggaataggccctgcaattcctgcacggttcccaccgcccccacacggatcacgcgcaaccgctctgctccgcaatgcctgcaatgccagtccactgctgatgcgccacaccagctgcatcgcggggcatcggccccgggaatacgcaccaatggcccgctgcaacgcaggcatcgagccagttgcaggcactgcgcgcaactcaacgactcggtgacgccatcgtgcggtatggagaacagcatggggccatgctcaagcgccttcgacagcacacgcaccgcagtgtgcggtaccctggcaccgacgctgggatcggcgagccggttgagttcgtcacggttcagccaccgtaccggcggtgcctggcttttaatcacatcggaaaagccgtgcaccgccacactcggaccagcgacctccgacacgaccgaggaggtttggctttcccattcactcaacacgctacgcgcccttccgattgcgacgaagacgcctccatggagcttggcacgcagacggcacacaccacgcgcattcgcatagggcatgaggccatccgcatactggtaggcgtcgtcgtccacaatcgcaaacagcgcctcgtccggtacgggcgcatacatggccgccctcgtacccaccacgcaagtgacccgcccctcgccaatcgccagatacgcccggtatctgtcggccggcgagagcgctgcactcaacaccgcgatgtcaccctcgtatatctgcctggcatttggcgcaaacacatggagtcccatgttctccagcgcatgcaccatgctccacacctcacgcatgccgggcatcaccagcacggcggatttccccgcccccatggcggtgagcgccatccaggccagtgtccgttcccatgcaccgacccccggaagggcatcgatgacgaacgccgagaacccctgcggtgcggtgagtgaggcacgtagggtctgtgcctgctcataggctttggcgatcacggggaaatggtcttcggcacgtgaggcgaaacgacccctgcgatcaaccatcggcgaatcggcataggacgcctcatcggcagccgactccacgtcgcttgccgattgcatggtggcattgggctccttctccacgccggcgaccctgcccggcatggccacgcgcagcacgttcgctatggtgccgccgtaggcattggccacggcggtgatgtcacggcgcatctggctcggtacgagcacgcgcggcgaaacgaccttctcgatgtagcgaatggcatttgtcggcgtatcgctgtcgttcacccgttcccaaataatgccgctgacgcgctggcctccgaatctgacccggaccagaacacccggctgagcggcttcgctcatgctgtcgtcgacgaaatagtcgaagggctgccccagatgcgtggcctgcacatccagcaccacccgcgccaccggcagctgggcagcaggctttctgggcgctgccttgcgcggcgagcgccgccgcatgcccatgccgtcgaaagccggctgcatcgcttcttcgggtgttccactcatagtgccccagtctaggctctcccctcattcaggtaaaggcgtcagcatgcgcgtgtccagctccatacatacgaaaaagcggcatgcgtatgagcatgccgctttccacgtgggcgtcagcttaccgactcagtggttcggccaccatggacgcaacgggtaggtgtcagtgccctcatcgtttggtttgatggcgaggaactgatgcacctgaatgttgttcatctcgaaattgaacgcgcaaccggccatatagagcccccacaaacgggccttcggctcaccgacgagcttgacggcgtcatcccaatgcgccaccagattctcgttccaacggtgcagcgtgagtgcatagtgctggcggaggttctcctgattgatcacctcgaagcccgtgtcttggatcaccatctcgatctcggccggtgaggagagctcgccgtccgggaatatgtaacggtcgatgaactgaccggctttcttgccctgatgcgagttgcaccgggtgatctggtggttgagcaatttggcgcccggcttgagcttggcgtagatctccttgaaatacgacgggtagtgcttgtgcccgacatgctccatcatgccgatggagcagatgccgtcgaaatcgccttcgggaacgtcacgatagtccatgagtcgcacctcggcgaggtcctccagtccttcgtctttgatccagcgctgagcccattcgacctgctcctcgctcagcgtgacgccgagggccttgatgccgcgcttggcagcttcgatcaccatggacccccaaccgcaacctatgtcgagcagtcgttctcccggctggagtgcgagcttgtcgagcacgaggtcgatcttgttcttctgcgcggcctcgagcgacatgagcggggagtcgaacaccgcgcaggtgtaggtcatggatggtcccaggaacatcgaatagaattcgttcgactgatcgtaatggtagctcaccgtggcctcgtcgccggccttcgaatgcggcagcagtccttcgctgatgcggcgggcacggcttgggccctcgatatcgggaggcgcgggacggtggaacccatgggaggccaccgaagcgagcgccttggccagttgggctggatttggtgtacgcaggtacgacttgagcggtacgagttccttgaacagcgcatatggattgccgggcacgagctgcggcgaatcgatgtccccctgcaggtaggcgcgggccaggccgagctcgctcggcgcattcaccatgtagtagatggcgcgcgagttcttcacctgcaacgtcagcggagcatcgtcggacccatacgacgacccatcgaaactttcaatatgcacaggtgcacccggcttgaggaacagctcgatcatctgtgccacggtcattgcggccatattcatctcctttggagattccttgctgcacggcgcattcggtgcagctgttgcattgagatatgccgttgcccatcctgcataagcagcttgccgggatggacttggtggtattcgtatcagtcgacgagggtggcgatggcccgcttgagctcatcgaccttgttggtgtgctcccaagtgaagtcatcgtcctcacgtccgaagtggccgtacgcagccgtcttcgagtagatcggacgcagcaggtcgagctcgtccacaatcgcggcaggacgcagatcgaacaccttgcgcacggcttcctgaatctgctcgcgggtcacgccgtccgcctcggtgccgtaggtctccacattgatgctcaccggctcggccacgccgatggcgtaggcaacctgcacctcgaccttatgggccaaacccgcggccacgatgttcttggcgacccaacgtgcggcataggccgcggaacgatccaccttgctcggatccttgcccgagaacgcgccgccgccatgatgggccgcaccgccataggtgtcgacgatgatcttgcgaccggtcagccctgcatccgctgccggaccgcccatgatgaacgaacctgtcggattgacgagcacgcggtagtcgtcgtgcttcaccgcatcccccagcacctcatcgagcaccggctcgatcacatgctcccgcagatcctcgcgcaatgcctcctgcgagacctcgggatcatgctgtgtggagatgagcacggtatcgacgcgcagcggcctgttctcctcgtcgtattcaatggttacctgcgtcttgccgtcggggcgcaggaacttcacctcgccgttcttacgcacctctgcgagccgatatgccaggcgatgtgccagatggatcggcaatggcatgagcacatcggtttcgtcgcttgcataaccgaacatgacaccctggtcgcccgctccttgtgcctcgtagcgctcctcgcgcgagacggcgttctcccggtccgagtcgatccgggaaacaccttggttgatttcagggctttgttcgctcagtgaaacaagaacgccacaggaatccgcatccagaccaatcaccgagctggtgtacccgatcctacgcactgtgtcgcgcacaatgctctggatgtcggagtaccctttgctcgtcacttcgccgaacacccagaactggcccttcgtggcggatgtctccaccgccacatgtgaatgcgggtcctggcggagcatgtcgtcgagaatggcgtcggaaatctgatcacagatcttgtcgggatgtccttcggtaacggattccgcggagatcagcttcacttctgccatgactcctcctctctatttcaatatgcgggcgtttgtctccacaattcaatcacatcttcgctactttcatacgcaagcgtaacttagcaccacctggattcgcggtcaaaccgggttggccgccaaaacaaaaacgccccaccaatatccggcagggcgcacatgcatgttcgtgaaagtctagtttccttcgctcagatcgtcttcgccgagcgtctcctcaagcaggccttcgttgatctcgcggaacgcgatcgacaacggcttctcctggctcttgtactcgacgagcggaccgacgttctgcagcagaccctcattgagctgcgtgaagtaggaattgatctggcgagcacgcttggcagcgaaaatggccaatgcgtacttggaatccgcatgctccatgaggtcgtcgatcggcggatccgcaagaccggtcgggataggctcagtgccgaatgccatttgaaatctccaaatcactagcaaatgcttatgcaaaggttcagtatacctcaagtcgacgaaaataggcaaactctgacagatgtacctattctgttgagattatggccgaaaattccagcatgcggaagccttgcccactctccgcgaagttcgagttgaatagatgcttatggaaatgcgatctgcaaaaatcatgaacggacgaatgttcgccggtgcccgcgcgctctaccgtgcggccggcgttgacagcaaggatttcggcaagccgatcgtcgccattgccaactccttcgacgaattcgtccccgggcacgtacatctcaacaaagttgggcgtctcgtctccgaggccgtgaagaaggccggcggcatcccgcgtgagttcaacacgatggccgtcgacgacggcatcgccatggggcacaccggcatgctgtactccctgcctagccgcgagatcatcgccgatacggtggaataccaggtgaacgcgcattgtgcggacgcgctgatctgcatctcgaactgcgacaagatcacaccgggcatgctcatggcggcattgcgtctcaacattccgaccgtgttcgtctccggcggccccatggaagccggcaccaccgtgctgccggacggcaccgtgaaggagaacaccgatctcatcgacgtcatgtacgcctctgccgacgactccatgagcgacgacgacctcctcgccttcgagcgcaccgtgtgcccgacatgcggctcatgcgccggcatgttcaccgcgaactcgatgaactgcctcacggaggcgatcggccttgcactgcccggcaacggcacggtgctcgcctcgcacggctaccgcaagcagctgttcgaacgggcggcacaacaggtggtcaagatcgccaaccagtactaccagcatgacgacgaatccgtgctcccccgttcgatcgccacgaagcacgccttcgagaacgccatgacgatggatgtggcgatgggcggctcgacgaacaccgtgctgcacattctcgcgatggcacagtctgcggacgtcgacttcacactcaatgacatcgaacgcatctcgcatactgtgccgtgcatctgcaaggcatcgccatccggcgaatgggagatctccgacgtgcaccgagccggaggcatcaccggaatcctgggtgagctcgaccgtgccggcaagctccaccgcgatgtgcattcgatcgactacccctcgctcgaggccaagctcgacgagtgggacatcatgcgcgactcctgcaccgaatacgccaaggacttctacagggcggctccgggccacatcgtctcccccgagccatggacccatgagacgaaattcgattcgcttgacaccgaccgtgtgaacggcgcgatccacgacatcgaccatcccgccgtgaccgaaggcggtctcgccgtgttgcgcggcaacctcgccccggatggcgccgtggtgaagaccgcaggtgtgccgaaggagatctggaagttccgtggtcccgcgctcgtcgtcgaatcgcaggagcaggcggtcgaggtcattctcaacgacacgctgaaaccaggtcaggcactcatcatccgttatgagggaccgaagggcggcccgggcatgcaggagatgctctacccgacctcgttcgtcaaaggcaagggcataggcaaggacgtcgcactgatcaccgacggccgctattcgggcggctcctcgggcctgtcgatcggccatgtggcgcctgaggcggcgagcggcggcaacatcgcgctcgtcgagaacggcgacatcatcaccatcgacatcccgaaccgcacgatcaacgtcgagctgaccgacgaggaactcgccgagcgccgtgccaaactcgaggccggcgatggctatgtcgcacaccgtgatcgcaaagtgagccaagcactcaaggccttcgccgccttcgccaggtcggccgacaagggcgccacccgcgaccccgagctcatcgaccgtctttcgggactggcctgattcggctgggaatcctcgatacctagaacctatgcgagtgggggtgccaccgatttcctcggtggcacccccactcgcattcgatgccgcatgccgtcagtcggtatcctgtggcaagccgtattcctgtgcgatgacattccacaggtcccgtgccgctttgtccacctgctcgttcacgatcgtcacatcgaactcgggctccgccgccagctccaccttcgcggtctcgagccgcttcgcctgctgttcaggcgtctccgtcccacgcccgatcagacgtttcttgagctcgtcgaagcttggtggcgcgatgaacacgtaaaccacgtcgagtccgagttccttcgcgcgctccttgacgcggcgcgcaccctgcaggtcgatctcgaggattgtcggcacgttccctgccaagtgctcacgtacgggttccaacggcgtgccgtagtgcgccatgccatgaacgacggcggtttcgaggaactcccccgcctcctgcctgcgcaggaattcgggttcgcttatgaaccagtagttcacgccatcgcgttcccccggccgtggatcgcgcgtggtggcggagaccgaaacccagacctccggatgcgccttgcgtaacgccgtctcgacggtgcccttgcccacggctgtggggccggtgagtacgatcagccggccgccttgccgctcggttgcctgcgattgccgggattgttcgctcattgttcctcccaagtgcgcaatcctttcggattcgccatgtgtccgcgtggcgccgtcgacgtgccgtcgatggcttcgcgcaatgccttgcgtacatcggcggcaatggtctgggtgctttcgatgagcgcgtccatgtcgggcccgctttgcgaaatcgcgcgggacaccgtcaccaacacattgccgttggtgccatggaacacgttcttcagatcgctgccctccgcaccttgccaaccgtagcccggcgagaggatcggccccgtgaaatcgcccggttcgatgccgctttcctgcagccattggctgatggtcgcgccaatgatgagtccgaccgaaccgaggcccttcactgatttattgtacttctgagcggtcgcggcgatgccataggccaccgtcttgcctttgtactcgccattctggcggattgcggtctgcagactcgcgccctccgggttcgacgtgagcgaggcgatgaagactcccctcccattgtcaagcgcatcgttgatcacaccaccgagcgaccgcgcaccgtagtatggcaacaacgtgatcgcatcggcaagcatgggcgcatctggcttgaaataggcgtcggcaatggccgagatggtggtcgacaagccgccatgcagacagtcgacaatggtgatgagctccatctggcgggccgcgtacagggcgcgttccagcgccacgaaaccgcgggagccgtagcgttcgaacatggagagctggaacttgacggctgcggccctgccgctggccgcctgaagcatacgcatggcgaagagctccgcgccttcggcgtcgacgctgtacccccagttctcgagcacgcccctatgcgggtcaatgcccacgcatagcggcccgtattgcttcattgagttgctcagccgcaatccgaagtcggagtgcatggcctcgcgttccttgtctgtgagcgattgtgtcattgcgcccgcgcttcctctccttcttccttgtgcttgcgttcgagttcgtagagctcacgggagtgctcctgaatgctcatcacctcgtagtcgttcttcttcacggcttcgatggccaacagcaccgcggagaactccgtcatcgttgtgtactgcggaatgtcggcggcaatggccgcggcacggatcgaatagccgtcggatcgggagccacgggagttcggcgtgttgaggatgagatcgatctggccttcctcgatgagctcgacgacgttcttgccaacgctacccgcggcatgctggatttcaatcggatgctccggatcggtgtccacccggctgtgaatcttgtcgacgatcttcgattcgatgccgtagcggcgcagcaccgatgcggtgccctcggtggcccagatctcgaacccaagctccaccagacgcacggcgaacaacggcagctgacgcttgtcggtgtcgttcaccgagatgaacacgttgccgttcgtcggcagtcccccctcgtaggaggccagctggctcttggcgaaagcatgcgggaaatcgcggtcgaatcccatcacctcgccggtggaacgcatctcgggcccaagcagaatgtcgacggtcttgccgaccggcgtgcggaagcgcttgaacggcagcaccgattccttcacggcgacctgctggccgaggcgcacatcgccgccatcgccataaggcagcaacaagccgttctcacgctgctgctcaatcgtttcgcctgccatgatgcgggccgcggccttcgccagagccacgccggtggccttggatgcgaacggcacggtgcgcgaagcgcgtggattcgcctcgatcacatacaacgtgttggccatgaaggcatactgcacattcatgagaccgcgtacctggcaacccttggctatggccagggtcgcctcgcgcagacgtcgaatctggtcgtcgctcagcgtgctcggcggcaatgtacaggcagcgtcgccggaatggacgcccgcctcctcaatgtgttccatgatgccgccgatatacagttcctcgccatcgaacagcgcatcgacgtcgatttcgatggcgtcctgcaggaacttgtcgatgagcaacggggagggaagacgccccgacaccacggtgtcggctttcgcctcactcagtgcgcggttcacataggtctccagctgcgcatcgtcgtacacgatctccatgccgcggccgccgagcacgtagctggggcgcaccagcaccgggtagccgatgttgtgggcggcctcacgggcctcttcgaggctcagcgcggtgccgaaacgcggcgcgttgagatgttcctgacgcagcacctcaccgaacagctcacggttctcggccaagtcgatggcctcgggggtcgtgccgagaatcggcacgccggcggccttgagacgtgcggcgagcgaaagcggcgtctggccaccgagctgcacgatcacacccttgatcgggccctgcttcttctcggcctcatagatctcaagcacgtcttcgaaggtgagcggttcgaaatataggcgatccgacatgtcgtagtcggtggacacggtttcgggattgcagttgaccatgatcgtgtcatagtccttgccgagctcctgcacagcgtgcacgcatgtgtagtcgaactcgatgccctggccgatgcggttgggtccggagccgagaatgatcacagcctcgcgttccctcttgcgcagttcggtctcatcggcatagcacgaatagtagtacggtgtttgcgcggcgaattcggcggcacaggtatcgaccgtcttgaacaccgggtgcagcccgtagttccagcgcagttcgcgaatcgtgttttcgccttcgtcaccgagtctgcgcagatgtgcgatctgcacgtccgacagaccagcgagcttcgccttcctgagcaggcgcttcgagagcgtctctgcgccgcgcacctgcatggcggtagcgttaatctggaagaactggtcgatgaaccacgggtcgatcttcgtggcgttgaagatttgttccggcgtcgcacctccccagatcgcacgcatgacctgcaggtaacggtgttcggtgggaatgcgcatctgctcgagcagctcgtgcacctcgccctcgctaggcttctcgccgtcccagctgaagcccatatggcgtttgtctatggagcgcatggccttcccaagcgactcctggaagttcccagccaaggccatggcctcgcccaccgacttcatcgaagtggtcagcgtcggatcggcgcccgggaacttctcgaaagcgaaccgcggcaccttggtgaccacatagtcgatggtgggctcgaagctggcaggtgtcgacctcgtgatgtcgttctggatctcgtcgagcgtatagccgagcgcgagcttcgtggctatcttggcgatcgggaagcctgtggccttcgacgccagcgcggaggaacgcgatacgcgtgggttcatctcgatgacgatgatgcggcccgtgtcggggtgaatggcgaactggatgttgcagccgccggtgtcgacacccacaccgcgaatgattgcgatgccaatgtcacgcagcttctgatactcgcggtcggtcagcgtgaagaccggggcgacggtgatcgagtcgccggtgtgcacgccgaccgggtcgacgttctcgatcgggcagacgaccacgacgttgtcgttgcggtcgcgcatgagctcgagctcgtattccttccagccctcaatgccctcttcgatgagcacctcgtcggtcggcgaatagtgaatgccagcaccggcgatgcggtgcagctcctcggtgtcatgcgcgatgcctgagccaaggcctcccatggtgaacgacggacgcacgaccagcgggaagccgaatcgttcggcaatggcgtccacttcctccaaggtgtgggcgatgtcggagcgcgccgactcggcgcctgcctccttcaccaccttcttgaacgactcgcggtcctcaccgcggtcgatggcttccagcgaggcgccgatgagctccacattgtatttcttgagcacaccggcctcgccaagagccactgcggcgttcaatgcggtctggccgccaagcgtgggcagcaatgcatccgggcgttccttggcgatgatcttctcgagaatgggagtcgagatcgggtcgatgtaggtggcatcggccatctccggatcggtcatgatcgtggcgggattcgagttgacgagaatgacccgcacgccttcctcgcgcagcacccggcatgcctgggtgcccgagtaatcgaattcggccgcctggccgatcacgatcgggccggagccaatgaccatcaccgacttgatgtctgtgcgcttaggcattcgcgttctcctccttggaagccttggaatctcgggaattgtccatcatggaaacgaagcggtcgaatagataggcggcatcatgcggtccagccgccgcctcggggtgatactgcaccgagaacgccggaatatcgacgcactgcaggccttccaccacattgtcgttgagatcgacatggctcacgaacaccttgccgtaccgaccgttctcaaacggggcgtccaccgtctcaccgattggcgcatccactgcgaagccatgattgtgggcggtgacctccaccttgcctgtggtcacatccttgaccggttggttgatgccacgatgaccgaacttgagtttgtaggtgccgaacccaagggcacgcccgagcaactggttgccgaagcagatgccgaagaacgggtagccggcgtcgagcacctggcgcagcaacgagaccatctggccggcctgttccgggtcgcccggcccgttcgagaagaacaccccgtcggggttgagttcctgaatctcatcgaaggtgacggtggaaggcagcacgaccacacggcagcctcgctcggccatgcggtgtggggtcatggccttgatgcccagatcgaccgcggccacggtgaacaacggctccttgccttcgaagtcgccagccggctcgaccacgtaggcttccggggtgctcacctcgtcgtagaggctcatgcccttcatctgcggggttcgttgcacctcttcgagcatgtcggaaatctcgcggggctcgccgttggaaccgacaagcgccgctcccgagaagattcccgcacgcatcacacctgccgagcgcaggtgtcgcacgagtttgcgggtgtcgatatgcgagatgcccacgatgtggttggccatgagatcgtcatccaacgaccctgcggcgcgccagttactcaccaccatgctcgggtcgcgcaccacatagcccgcgacccagatgcgggaggattccaaatcgtcatcgttgacgccggtgtcgccgatgtgcgggaacgtctgcaccacgatctgacgatcgtagctcgggtcggtcagtgtttcctggtagccggtcatcgcggtgttgaacacgatctccgcgcaggtggatcccgtggcaccgaatggctcgccaacgtacacctgcccgtcttcaagcacgagaacggcatcctgagccgtgtattcattcgccggatcgaactgagtcaccatacccccattcgtcaaaagtatttgaggaaagcggccggttgagagtcgcgatccggccgaacgcgattacctgctaattggtttggtcggattcgtccttgtcggaatcatccaatggtgtggactgcggggactgcttgtccttcgccgccacaatggcacttaacacaccgtgaatgaacgaaggggccgcatcgtctgacaacgtcttcgacagattcagcgcctcgtcaatggccaccttgtcgggcacatcgtcgttgtagagaatctcccacgtcgcaatgcgcagaatgttgcggtcgatcgcatgcatgcgcttgaccttccaaccggtggaatgcgtattgagctgggaatcgatgtcacgccggtgctcatccacgccacgcacaatctcaatggcgtattcgggaagcggcgtctgtgcaccgggctgagcgatgcgttcatcaagaagggacaggaaatcctgccccttctcatccgcttcatacaacgtgttcagagccctgcgacgagcggtcgaacgtgccatacaagcttatccttttcttcactgtgggcggggcaccggcatgcgatgccaatccccgcccgcaagtcctgcttctgtgagtgcgagtggccgatctcagttctcgcggcccaggtaggagccgtcgtcggtgttgaccttcaccttctcgccctcgccgatgaacagagggacctggatttcggcaccggtctcgacggtggccggcttggtgcccgcgttcgaacggttaccctgcagacccggctcggtgtgggtgatggtgagcacgacggatgccggcagttccaccgacagcggctggccgtcgtggaaggagacgatgcagtcggtgccttcgaggaggtacttggccttgtcgcccacgagcgtcttcggaatcatgatctggtcgaaggtggtcatgtccatgaacacgaagttgtcgccgtcctcatacgagtactgcagcgtgcggttgtcgacggtctcgaaatccatcttcatgccggcgttgaatgtcttgtcgacgatcttgccggagagcacgttcttgatcgtggtgcgcacgaaagcggggcccttgcccggcttgacgtgctggaacttgatgacctgccagagctggccatcgagattcagaatggaaccgttcttgatgtcgttagtagtctgtgccaaattactcacctattcgtgtcgactatacagctatatagagccttgcatattatgccagcacctctctacagtcatatgtgcactgttgtacaccgttttcgtcgtgcacgcacgttcgcgtccatttctcagacctgcatcgcctggtcatcgcaccgcatttttctgttcgcccggcggcaatacacggcatcttcgcaccattccacagattgacggggtatatcaacaatctgtatgccgtctgcacacccgtgcagtgcaaggagtaaggatgtccatgtcagaggaaatcaaagattcacgcatcaccgatgcactcgcgaaccgccgttcggtcatcatcgtcggtcgcgccaccatcgccgccaagctcgcgctcttcgagtccctgctcgcgaatctgcccgaatccgcaagactcggtgtgatcgatgagagcggcgcgttggccgagattcccgagaacgccacggtgatcgatgccaagctcaagggtgtcgatgcgatccaccgcatcattcgcgatgacaagctcgatacgatcgcctgcccaagcatgcgccgcggcgacatcgttcgcatgctgatggatgtctccggtcaggagaacggtcaggtgctcatgataaacggcaatatcgacgatgccacgcaaacgctcacctccgatctgcctatgatcctgctcaagagctcgccgtccggccacaccgagttctccgacgccgccatcaaggcaatgaatccggtggtcatcgaactctccgccgacgattcgattcgcacggtcaccgaagtggatcttcatgccgagggcctcaacaccatcgacgtgaggtaacgcgaacactcccggtttgctgtgtggatgcacacttgaacatgacgaattttgtgtgcatccacatagtatttgtatggaatcgtgtcatagaatatgcgggtcgcccgaattcaggggcattgcggaaaggtttttctatggtacggagcagaaccgctcaactcattttccaatcgttctactgtgcattcggcatagtgggaatactcggcagcttcggcatgtatgacggcagcttcgacaacgtgttctacgtgtatttcacgaacctgtcgaattacctgtgcattgccgtcatgttcttcgaactcgtgcagacggccaaccgcaagcaagacggctatgtgaagctctcccccgccttgaagttcatttcggtcactgccattctcctcacgttcttcgtgttcaacctgctgcttgccaatgcaccggatcgcaacccgctcgagaacttcaaagtcacgagcatcacgttccatgtggtgctgccgctcatgttcgttgccgattggctcctgttctacgagcataggaaagtgaagtggacgtacccgctctattccacggtgttcccgcttgtctacctcgccttcgtctatatgcgcgcgtggctggtcaactttgacaccgcggtgccgaaactctacccgtatttcttcatcgatgccaatcagcagggcattgcaggcgtggtgcgttggtgcctgattctgcttgccgcattcattgtgctcggttacattctgatggccgtggaccgtatgatgccggccgcaaaggaatccacacccatcgattccgccgactgagccactgactgttttttattgagctttgccgtttctgggcgccgctgttgcggcgccttttgttatttgtagattgcggtgctccttttctccccttggtgaattccacccgagctgttgccattcggcaacacgatagacgatcccctgtgttgacagatatgcgcaaggacacttcggaatcggtgccttcggacaacgcaaaaggccccacagtttcctgtggagccttttgggaacgctagttcatgcgcgtctgtcgcacgcttgattcattggaatcaggcgaggatcttggtgacacggcccgagccgacggtgtggccgccttcacgcactgcgaaggtgaggccctcttccatagcgatcggctggatcagctcaaccgtgaaggtcgcgtgatcgccaggctgaaccatctcgacgccttccggcagcgtgatgacgccggtgacgtcggtggtgcggaagtagaactgcggacggtagttcgagaagaacggcgagtgacggccgccctcatccttggtaaggacgtagacttcgccttcgaacttggtgtgcggggtgaccgaacccggagcagccacgacctggccacgctcgacgtcggtgcggttgatgccgcggagcagcagaccggtgttgtcgccggcctcgcactcatccatctgcttgtggaaggtctcgatggaggtgacggtggtggtctgggtcgggcggatgccgacgatctcgacgttcgtgttgatcggcagcttgccgcgctcgacacgaccggtgacgacggtgccacggccggagatggtgaagacgtcctcgatcggcatcaggaacggcttgtcgaggtcgtggaccggggtcgggatgtactcgtcgacgtcgtccatgagctccttgatggtggcaacccacttgtcgtgatccggagcgtcgtcatgcagagcgccgtaagcggaggtgtgcacgaccgggcagtcgcggtcgaagccgttctcgtcgaggaggtcgcggacctcttcttcgacgagctcgatgagctcttcgtcatcgaccatatcgcacttgttcagagcgacgaggatcttcgggacgccgacctgacgggcgagcagcacgtgctcgcgggtctgggccatcgggccgtcggtggcggccacaacgaggatggcgccatccatctgggcagcgccggtgatcatgttcttcacgaagtcggcgtggcccgggcagtcgacgtgggcgtagtgacgcttggccgtctggtactcgatgtgggcaatgttgatggtgataccacgctgctgctcttcgggagcggcatcgatctggttgaagtcgtactcagggttcagatccgggtactcatcgtgcagaaccttggagattgctgcagtcagggtcgtcttgccgtgatcgacgtggccgatggtaccaatgttaacgtgcggcttagtacgctcgtacttttcctttgccatatgtttttgtcctcctggacgttctcgtagtaagccttgatcactcaaggcacttgctacattttactgggtttctgggtttttgccactttggacccgaacccagtcagcgctacagaattctagcgccgactggagacaggttcaagttgtgttgtgcgtgattcgtaacggatgtcactcgccacgctgggccttgatgatctcgtctgcgacggccttcgggacctcagcatacgagtccatctgcatggtgaacattgcacgaccctgggtcttggatcgcaggtcgccaatgtagccgaacatctcgctcagcggcacctttgcgtcgatgaccttgacaccggtggcgtcgttcatcgactggatggagccacgacgggagttcagatcgcccatgacgtcacccatgtactcttccggggtgcggacctcgacggccatgatcggctcgagaatgaccggcttcgccttcggggcggcttccttgaagcacatggagccggcgatcttgaaggccatttccgaggaatcgacgtcgtggacctgaccgtcggtgacggtggccttgacaccaacgaccgggaagccggcgagaataccggattccatggcctcctgcacaccggcatcgatcgaaggaatgaattccttggtgatgtggccgccggtgacctcgttcacgaactcgtagacttcgccgttctcggtgtcgagcggttcgaagttcatgagcaccttcgcgaactggccggaaccaccggtctgcttcttgtgcgtgtattcctggttcatgacggccttgcggatcgtctcgcggtaggcgacctgcggcttgccgacgttgcactccaccttgaactcgcggcgcatgcggtcgacgatgatgtcgagctggagctcgcccatgccggagatgagggtctggcccgactcctcatcggtcttcacctggaaggttggatcctcgtcggagagcttggcgagggccaggctcatcttctcctgatcggccttggtcttcggctccacggccacctcgatcacaggatccgggaaggtcatggactcgagggagatcgggtgcttctcgtcacacagcgtgtcaccggtggtaacgttcttgaggcccacgaaggtgtagatgttgccggcctcggctgcgtctaccgggttctccttgtcagcgtgcatctggaagatcttgccgacgcgttccttcttgcccttcgtggaatcgagcacgttgtcgcccggcttgacggagccggaatagacgcgcacgaacacgagcttgccatagaacgggtgcgtcgagatcttgaacacaagggccgagaacgggtcgtccatggtgggcttgcggtcgatctcgacggattcatcggacggatcgaagccgacgatggaaggaacgtcctccgggctcggcagatagtcaacaacggcatcgagcatcggctgcacgcccttgtccttgaaggcggaaccgcagagcaccggataagcctcgcgggcgatggtgagctgacggatggcgccacgaatctcctgctccgagaggtcgccgttctcgagatacttctcgagcagctcctcatcggtctccgcaacctgatcgagcagttcggaacggtactgctcagcgcgttccttgagatcgtccggaatctccacggtgtcatagtgggcaccctggtcgtccttgatgtcgttccaaacgtatgccttcatacggatgaggtcgacgacgcccgagaaatcgttctcagcaccgatcggcagctggacgacgagcggagtcgcaccaagcttctccttgatggtgctcaccgagtagtagaagtcggcaccgagcttgtccatcttgttgatgaagcagatgcgcggaacgccgtacttgtcggcctgacgccacacggtctccgactggggctccacaccctccttgccgtcgaacactgcgacggcgccgtcgagcacgcgaagcgaacgctccacctcggcggtgaagtccacgtggccaggggtgtcaatgatgttgatctggaacttctcgtccggatcatgagtctggcggttccagaagcaggtggtcgcagcggactggatggtgatgccgcgttccttctcctgagccatgaagtccatcgtcgaagcaccctcgtgggtttcgccgatcttgtagttcttaccggtgtagaacagaatacgctcggtagtggtggtcttgccggcatcgatgtgtgccatgatgccgatgttacgaacctggttgaggttggtaagcacgtccagtgccatgaatgttccttaactcttcgttgctcgacttaattaccagcggtaatgagcgaaggccttgttggcctctgccatcttgtgggtgtcttcacgacgcttgacggatgcgccaaggccgttggacgcgtcgaggatctcgtttgcgagacgctcggccatcgtcttctcgcgacgggcgcgggagaagtcggtcagccagcgcagcgacagcgtgttcgcgcgagcgggcttgacctcgaccggcacctgataggtggcgccaccgacacggcgggagcggacctcgagcgacggacggatgttgtccagagcgcgcttgagcactgcaaccggttcctgatcggtcttgtccttgaccatatcgagtgcggaatagacgatgtcctccgcgatcgacttcttgccgtcaagcaagatcttgttgatgagctgtgccaccacgatcgagccgtagatcggatctggaagcacctggtgtttcttggaaggtcctttacgtgacatatctcttacttcgccttctttgctccgtacagggaacgaccctgcttgcggtccttgacgccctgggtatcgagtgcaccacgcacgatgtggtaacgcacgcccggcagatccttgacacggccgccgcgcacgagcacgatggagtgctcctgcaggttgtggccttcgcccggaatataggcggtgacttcgatgccggagctcagacgaacacgagcgaccttacgcagtgccgagttcggcttcttcggggtggtggtgtaaacacgcgtgcacacgccgcgacgcagcgggctgcccttgagagccaaagtcttggacttcttcggctttgccttgcgtcccttgcggacaagctgttcaatagtaggcaacttgattctccgattcagtttgtaatgttcttctttgtggagccgcgcctttgtgacccacttctccgaatcggattagctagccaacgttcaccggcccgatgacccctcgccctctcaccgccgcattactgcgcgtgatcatcgcgaactcggggatatcccagcatgtacacctgtcacataaggtgcactgctggcacacacaaacgtctactataccatgacggcagacaaaagacggccccggagtgtctaggtgcctccggggccgtctagcttcccatcaccatactcaacaacggggcgaacgggatattccaccattcgccggccatcacatatggcacacatttctcgctctctgccgcatgcctcggcttgctgtcgccgacaggccgggcatccaccctgatgcctcagccgcatgcgcatggcttgcattcgattcactgccaccaattcgaccaccgtatttgcgacatttgccgactcacccgcacaccccgggtgccgccggcccaccatacgcgactcatatcgccacgcgcatcaaccatatggcctttctgcacatagcggcgattgcgtttccattttggtttccaatacttcccctgccggcccctcgcctcgaggccgtgcaatcgccatcgcacccgcttatatgacttcatggacttctctgctctgtccgttgagttatgccgcattggcgctccctgcgccgcacgctcctatgcgtgcccaaaacccttggaattcgtttcttcttggtgtatatccaagtatacctacgcccgcattgattgtataggcgacacgccgaccccggttttcggggaaccctcgtgtatagttttcatctgttgcgtgatgctcagcagacacgtaaacatggtggctatagctcagttggtagagcatctgattgtggttcagaaggtcgcgcgttcgagccgcgttagccaccccggccaaaccccgagattccaacggtttccaaaccgaacgaatcccggggtttcctcgtttcggtaacgatgaataacgatggcgtcccgccaccctccccattttgccatggcgttcaccgtgcgcggcaatggtgcttgcgctcggttcccgggcgtagactacacagcagaaccgcacgtaaccacaatgagcaggagtgcatatgctgtctttcgaaaacgattattcctccaccgccgccccgcagatcgtcgcccgcatgcaggccatggcgaacgaacagaactccggctatggcaaggaccagtattgcgatgcggccgcaaacaagattcgcaaagcctgtgatgccgcacaggccgacgtctggttcctcgtgggaggcacacagacgaaccagaccgtgctcagcgccattaccccgcaatacgcaggcgtcgtatgcccggagagcgcgcacatcaacacgcacgaggccggcgccatcgaggcgactggacacaaagtgctcgcactcccccagcacgacggcaagatcaccggcgaacagctcgacgaatactgtcagagcttcgaaaacgacctcaaccatgagcatatggtctaccccggctgcgtgtatatctcgcagcccaccgaatatggcaccgtgtacacgcgtgaggagctcgcctcgatctcacaggtcgcgcatgaccacaatctgcctctctatgtggacggcgcgcggttgggcatggcgctcacggcggacatgaacgacgtgcagctgcccgatctcgcccgtctggcggacgtcttcaccattggcggcaccaaatgcggcacgatgttcggagaggccgtcgtgttcccgcgcggtaattcgccgaggaacttcacgacgatcgtcaagcagcacggtgcactgctggcgaagggctggctgttgggactgcagttcgacacgctgttcaccgacgacctctacttcaagctcgccaagcatgcgaacgccgaggcggacaagattcgcaaggcactcttcgagaagcattacgacatcgaatacatctcgcagaccaaccagatcttcatcgtggtgaccacgcagcgcgcgcaggaactcacgaagtccgtcaagctcggattcatggagcaggtggatgccgaccatgtgatgctgcgcatctgcacgagctgggctaccaccgacgagcaggtggacgagctcatcaagctgctctgattcccgtaacaggctgggccctgcggatttcatatccgcagggcccagcccataacgatcagctacagttagcgtgaggaaaccgtgtggtcggagatgatctggcgttccatctcgacgaaacgcctcaccgactcctccaccgaatacgtgtccttcgtatgacgcgcataggtgtcgccccacgtgttgagctccctgggatggtcgatccaccagtctatgcgttcggccaacgcgtccacatcgcccactgggtatgaggattgcgggcagagcgagaactggcctgccgcactcagtttcgaatcggcaatcaccggcaccaagcccgaggccatgccttcgatgacgctcaccgattcgaggtcggcgatcgaaggatgcacgagcaggtctgccgaccgcaacaactggggcatcgtcgagttcttgtggaagccgatcgaggcaggacgcttgagcttcctcttggcgaaacgcacgagtttgttccggattggccccgtgccggcaatcgtcagatgaatgtcgtccgcatgcgcacaacggcagatcgcctcgatgagctcgacatggttcttctcgttcgaaaggcgacccgaagcgatgatgcgcacgggaatctgcggtgcggcatcgcccttgcgctgctccttcggtatgaaccgcggtgcgtagccgttcgagatgacgaagatcggtttggcatacccgtggtcgagcagcaattgcttccccagattcgtgggcacatggatggcgtcgaccctggaatacagccagcgcctgaacagccagtagatgaaccgatccatgccggggatccatcgggccggccctgccgaatacatgacgttctccggctgcacatggaagccagcagtgaccggcaggcccttggcacgggccgccgccatggcatgccggccgaatttgaacggtgtgtagatgtgcacgacgtccacaccatcgaaggcgcggtcgaacagtgtggcgctcggctgggcgaaatgcatctgctgcttggccgaaatccagctcaccaacggaatgtggttctctctggccggatattcgggggcattgatccccaccaatcgaaccttgtgaccctgccgttcgagttcctgcgcccattggagcgctgagttcgaggtgccgttgccgcggttgccgaaagtgtccacaaccagtgcgatcgtcagtggcctatcggttgcgttgtcggacgccgactgcggcgacgctgcttcgttgtgtgcttccatagtgctcatctaacccgctggactgtatatttcacggtattcgcgcattgtctttttgcgaatccactcccccacgccgcgaatgacacgactgatggcacaatggaaccatgactacagattccatgattctcggcacaccattcggtgaacatcccacccgcattctcatgctcggttcgggcgaactcggcaaggaggtgacgatttcactcatgcggctcggcgcatgggtgtgcgccgctgattcctacaacggcgcaccggccgcacaggtcgcccacgaggcacgggtgctcgacatggcgaacgccgatgcattacgcaatgtgataggcgacgtcaaacccgacatcgtcattcctgaaatcgaggccatagccaccgacgtgctgttcgaagcggagcaggccggcatccgcgtggtgccgagcgctgccatcgcctcaatttgcatggatcgtgagcgtcttcgccagctcgccgccgacgagctgggactgcccaccacgaaattcgaattcgcgggaagcctgcaggaactcaaagaggcggccactcgcatcggcttcccctgcgtggtcaagccggtcatgagctcctcgggccacggccagtcggtggtgcgatccgccgacaagatcgaggacgcatggaatgaggcgcaaaccggtcgccgtgcgcatggggagggcgatgtctcccgcgtgatcatcgaacagctcgtcgaccttgattacgaactcaccatgctcaccgtgagctcatcggcaggcattgtggtgtgcgaaccgattggccagcggcaggaaagcggcgattaccgtgattcctggcagcctgcggccgtcgagcccgatcatcggcaggaggtcaaacgcattgccacgcaggccgtgcagggtctcatcgcccatgccggcaccgacaccgcatggggcgtgttcggcgtcgaattgttcgtgctcaaagacggcaccgtgctcttcaacgaggtctccccccgcccgcacgatacgggcatggtcaccatgatcagccagtatttgagcgagttcgacctgcatgcgcgcgccgtgctcggaatcccggtctccaaggcgcatatcggactcgacctgccgaagtattacggcgcggcgagccatgcgatcgtcgtcgagggcaacggcgaagtcgaattctcgaacctccagaccgcactcgccacaccgggcaccgatttgcgcatcttctcgaagccgcgggtggagggccatcgccgcatgggcgtgacgctcgccatcggctccgacatcgacgaggcgcgcatcaaggcgaacgagtgcgcgcagaatctgcgcatagtggtgaatccggcgaagtagtgtcgacgccaccgctcgcgaacctcacgaaaaccgcgtgtcgaatactgaaaacagtgagtaaactgggcgtttttggcgtgttgggttggtacgctgaaaacgtccactcattgttgacaacggaaggcagcacatgcagaagctggacaagctctacgagggcaaggccaagaaactgtacgcaaccgatgaccccgatgttctctgggtcgaatacatgaaccaggcaaccgccggcaacggcgccaagaaggcacagatcgaaggcaagggcgaactcaacaaccagatcacctccgtcatcttcgacctgctcaaggcgcgcggcatcgactcccacttcgtcaagcgcatctccgacaccgagcagctcgttcgcaaaatggacatgtacccgctcgagatcatcatgcgcaacacggcggccggttccttcgccaagaggtacggtgtcgaggaaggcaccgcgctcgacaagccgatcctcgaattctgcgtgaaatccgacgagctcggtgatccgttcatcaacgacgacggcatcgtggcactcggcatcgcctccgaagaggagctcgacgagatctcccgccaggcacgtgcagtcaacgatgcgttgaaagacatcttctcgaagatcgacgtgcagctcgtcgatttcaagatcgaggagggcaagaccggtgacgggcgaattctgctcgccgacgagatcaccccggacacctgccgtttgtgggacctgaaggacggctccggccagatcgagcatctcgacaaggatctgttccgccgcgatctgggcaacatcatccccgcctacgaggagatctacgaccggctggtcaagctcgccgaagccgagggcgtcgagcgcgccgagtgacattggggcctgttccatgacttgagccatggaacaggccctttcttgttttcctatattgttttcaacggtacaatcccagattattgctaaagaacgaggaagcacagtggtttttcgcgtccatgtagagaagaagcccggattcgacgtcgaggcgcagcagctgacgaacgaattgcgcacgattctcggcattgaatctttgaacaacgtccgcatcatcaaccggtatgacgtcgagggaatcagcgaggagctgttcggccagacgatccccaccgtattcagcgagccgcaggtggacaatgtgagcatcgaactgccggatgtctccggtgacacggtgtttgcggtggaatcgctgcccggccaattcgaccagcgcgcggattccgcaagcgaatgcatccagctcatcagccagggcgaacgaccgaccgtgcgctcggcccgcgtgtatgtgctcgatggccagttgggcgacgacgacctcgccgcgatcaaaaagtacgtgatcaatccggtggagacccgcgaagccgggctggagacccgagagacgctcgccacctatgcccccaccccccagccggtcgaagtgctcgatggcttccgcgaaatggacgatgcacagcttgccgagttcatcgccgatcggggcctggcaatggacgaggccgatctgaggttcgtacgcgagtatttccagggtgagcaacgagatcccaccatcaccgagatcaaggtgatcgacacgtattggtccgaccactgccgccacaccactttcggcaccgagctcgactccgttgaaatcgacgacgccgtggtgaaggccgccttcgacaagtacatggcgatgcgccatgagctcggccgcgacgagaaacccgtgtgcctcatggacatgggcacgatcggtgcgaagtggctcaagaagaacggcgtgctcaccggcctcgacgaatcggaggagatcaatgcctgcaccgtcaaggtgaaggtcgatgtgaatggcgagagcgaagactggctcttcctgttcaagaacgagacccataaccaccccaccgagatcgagcccttcggtggcgcggcaacctgcatcggcggctgcattcgcgacccgctttcgggacgctcctacgtgtatcaggcgatgcgcgtgaccggtgccgcggacccccgcgtgccgatcagcgagacgctggaaggcaagctgccccagcgcaagctcgtcaccaccgcggcgcacggctactcctcgtacggcaaccagatcggcttggccaccggtcaggtcaatgagatctaccacccgggctatgtggccaagcgtatggagatcggcgccgttgtgggcgccacgccggcaagccatgtacgtcgcgagaccccggcccccggcgacaagatcattctgcttggcggccgtaccggccgtgatggcattggcggcgccaccggttcgtccaaggcacacaacgttgagtcgcttgaactcgatggagccgaggtgcagaagggcaacgccccagtggagcgcaagctgcagcgtctgttccgccgcggtgatgcctgccgcttgatcaagcgatgcaacgatttcggcgcgggtggcgtgtccgttgccgtcggagagatagccgacggcctgcacgttgacctcaatcaggtacccaagaaatacgacggcctcgacggcaccgagcttgccatctccgagtcgcaggagcgcatggcggtcgatgtggctgcggaagacgtcgacgagttcctgaagtatgccgccgaggagaacctcgaagccgtggtcattgcgaccgtgaccgaagaccctcgcatggtgatggaatggaacggcgagccgatcgtcgatctctcgcgtgagttcctcgcttcgaacggcgccgccaagcatcaggatgcccacgtgccccagcagggctcctaccgtgccccattctcgtccggctcactcagtgagcgtatgaacgagatgctctccgacatcaacatcgcctccaacaagggcctgtcggaacgcttcgactccacgatcggagccgccaccgtgctcatgccgttcggcggcaaggaacagctgacgccggcggaagccatggtggccaagttcccggtgttcggcgagaccaccaccgcctcggccatggcgtggggcttcaaccccttcctcatggaacgcaaccagtacacgggcgcctacatgtcggtggtcgaatcgcttgcgaaactcgtggcggcgggcttcgaacacgaaaaggcatacctcaccttccaggagtatttcgagaagctgcgcgacgagccagagcgctggggcaaaccgcttgcggccgtgctcggcgccctcatggcgcaggtggacctcggggtcggcgccattggaggcaaggattccatgtccggctccttcgaagacctcgatgtgcctcccaccctcgtctccttcgccgtggcggtcggcgacatgaaccgtgccacgtcgccggagttcaagcaccccggcgaccgtgtggtccgcatcgcgccacgctatctggcggacggtatcacaccggacaaggacgcactgctcgaggtgttctccaccatcgagaacctggtgaccgacggcgatgcgctggccatctccaccccggcttacggcggcaccgcagaagcgttgttcaagatgtgcgtgggcaaccgcatcggcgtggcgctcgacgactccatcgccgtcgacgatctgttcgcaccggcgtatggctcgttcatcgtcgagctcgcgccatccgcgaacatgccgacagtctccaatctggtcgagatcgggccgatcggcgagaccaccgcggactacgtgttccacgcagccggcgagacgctcgacctcgcgaatctgcaggaggtgtgggagaacggcattgcatcggtgttcccctaccgcagcggtgaaaccgatgccgaagccgaggcggtcgacgcgatctcgttcgagacgatggaaccgaccgtgtacaagggtgcgaaaatcgccaagccgcgcgtgatcatcccggtgttccccggcaacaactgcgaatacgacaccgcggcagcgttcgaacgcgccggggccgaggcgcagacgctcattgtaaacaatctgacgccctcagctgtcgccgagtccacgcaggcgctcgtcgacgccatccataacagccagatcatcatgatccccggcggtttctcaggcggcgacgaaccggatggctccgcgaagttcatcacggcgttcttccgtgcaccggcggtcaccgaggccgtgcgcgacctgctcaacaaccgtgacggtctcatgctcggcatctgcaacgggttccaggcgctcatcaagctcggtctcgtgcccttcggcgacattgtgcctatgaccgcggagtgcccgacgcttacgttcaacaccatcggacgccaccagagccgtcttgtacgcacacgcgtcgcgtcgaacctgtcgccgtggcttgccaagacggaggtgggcgatatgcacaccatcgccatctcccatggcgagggacgtttcgtcgcttccgacggcatgctcgaccagctcatcgcaaacgggcaggttgccacacagtacgttgacgaacatggcgtgccgagcatggacctgagtgtgaacccgaacggctccatgctcgccatcgagggcatcaccagcccggatggccgcgtgttcggcaagatgggccactccgagcgcaccggcgacggcctgtaccgcaatgtgcccggcaacatctaccagccgatcttcgaagccggcgtcgagtacttcggctgagacggttatagacgctgatcgaccatagcgaagggcggtgtatgccatatatggcatacaccgcccttctgttcatcaacgcattcgacttcttttcttcgattattaggcgggtcggaaaaccatctttgattgttaggcggttatcctcggcacttattccttcctaacgccattttattagacataacatattattctgtcgtatttttgcttgagttcgggccgcctctactcgtagcacccacctaacaatcgaagatggttttccgacccgccccaacaatcgccgataggtctcctagaggccgagaatctgccgctttttcacattgaattcctcctgcgtaaggattcccgcatcgagaagctccttgagcgacttaagcgcctccatctgctccgtcaccgacatggcggattgcgttccctgtgcagccggaggttgtgcggcagcttgcgcgacggtgccctgcgcatccgctgccactgcggctgccgcggccggattcgtctgagtaggcacagactgccccggcatcgcgccggtcatcggattgactccctgcgcgaaaccaagcccgagcatcatgccacccatgtcgccgaacccgttctgctgcacgccctcggcgatcttctgctgcgcggcgatgttcgaagcctgctgcgagatgttctcgtatgccgaaagattcatgcggttcgacgagtattgcttgacaagctcacgcgattcgtcggtgaattcgatgctctcgatgcctatgcccaccaagtgcagaccgaaacgcgactcccatgtgccggcattcgacgaatcccctgagatcgcgagcgcaatggaattcgcctggctgggcagcgcggagatgcggtattcgtttgacagcgagttgagcgccaccgagaacgactgcatgaattcggagaggatctgcgatttcgtgttcgggtcgtcgaagctgatgtagtccacgttcggaggcacgaactggcgaatgaatgcgagcgggttgaccacctgcaccgacatcatgccacgcgcacgaatctccagatcggtctggtagaacctgtcgtggtacatgagcggtgccggcgtgccaaatttgatgccgcggatctcacgcagattcacgaaggcgatgcgtttgttcgccaccggctcgccgccgtatttgaaccgctcgcctatctgctcgaagatcgacttgcctatgccgttgcctgcgaacacgctatcggtgccgccggtgcggtattcgtaaccgcctgactcggtgatgatgttctcgatgccggactggtcgaagatgaatgcggccgtgttctccggcacgtagatgcgtgaaccgttggagatcaccgcctccgaatgcttcgtattggagccgcggtcacggttggtctcctggtagatgccgggcatgagcacagcatgctcgtcgaattgcccaacggtgatgatgtcgagccattgatcggcgaaggtgccgctcaatgctccggcgaatgctctgatcaatgccattgctgccttctttcacagagttcgtggtggttcagagttgctctgacctaccgcagtattcacaggtgacgctggtaccttggcgcccgtgcagcggggcaccgcaacctgcgcaggcgcgcgagaccattttcgattcggcgctcttgggatttgccgtgtttctcaggccgaaggcttcggtgacctccttgcccgcgtcgctcagcatgctggcgattcccgagatgaaggttttcggtgcgccgacaatgtcttcatcgttccccgtgatcagcttgttgatgccgttcgccaacgtcaccagatccgcatgcgagtccatgcgcagttccagctttcccttacggagcagaatgtcgcattggtgggcgtcacccttgtcgataatgagctggggcctgccgtccaccactttgatgtcatgcaatgcccacaagaaggtgtgctcaatgtctttgccaaacaccttgacctgggtgtaggagaagatgagactcatggtggtgaaggtcagttctccagattcgcatcctttgaaatcaggactctcacagcgtacactgtcgaattgcgcaacaatcccctcatttggcagcagattgacgctacgcatacagctcctccctacttctcgcggaacatgctcggcctgtctcgatttccactcgtcagaactgtctcacccgtcacatgttggggatggctgctttgttgtggcgtttgattgcgatcatccagatggatccggcgatgactgcaatggcggccacatagaacaggtagacgccgaaaccgaagccatatgaaccgtatggtgtgaagctcaggttgaagtagacgtatgcgagtatggcgagaacgacaaagacaagcgtcggaatgcctttcgcggcaagggcgaagatgagtgccagcacggtgaagattgcaatggcaatgatcatcacgagaatgatttcggaaacacccacgctcatgttcgcgaccgactgcatttccttccatcgttcggcgatggtgaacgccgtcatggtgtcattgctcgacgtggcgtacggcagtacgagtgagacgagcatggcaagcgatccaatgatcgtgagggcgcgtgggcctgccaatgatttcttgttcatattactcctcaatagttgttccagattgatgattgatcggttattgttgttttggcatttcgaggggcagcgctgatgctgtttgcgccatcgtctcggatatcgcaagagtggtagaatacctgatctgcaccactatggtcgcgcataacagcagcaccgatgccaggcaggagatggcgaaagcgatcagcaccagatttctcccggagaccttaccgttgcggccggtaaccgcgaacgcgatgccgcatacgacaaacagcgagacgatgagcgtgacgcacacctgccagtccggacgcaggtcgctgaacatcgccaacgctcccagcagcgcaccacatgcgaagacgacggcaccaatcgcccactttgatctcggaccatcattgtctgcgacaatggcttgccggaatctgcgtttggcgatgacgtcatggggtacaacggtgctctgcgcaacaatctgttcggccaattctcggtacagccgactgtaggctgcgcttccgcccgccgtccccgccggagcttcgatgatcaccgcactgtgcatgccatcagcgatgacccgggcctcgtactcgccgttgtcatttggcagccggaatcgcacggaatgcgtgacgtcatcgttggcgacgacgtcaaaccccgcactgaagtgcaatgtctggacgagcgcggcgtacacttcagcgaccggggcgcggaatgtctgccgcgccacaggcacacggttcacggcgggagtcgaggcgctcatatcgtcttccgaggatgcgatgaaatcagctgaccgaggcaagacgctggttgacacggttggttacttcgatgaagtagttcatgtctgcgtcggtccatgctgactgatccagattgctcaatttctgtgtgtaatcggtgtactcgttgagcatctcaagataatcagtaagcatgcctgcaggacggccttccttggcgtatttctccatgaaatcacaatacttattcatgaaggtctcataaccatccaaggcctccttcacgtcgggagtcacaccattggcagcattactctgcgtgttctgcttctcggcggcctcctctttgagtttcttctcctcctcggccagccgcttctgttcctcttccgctttctttgcctcctctgctgcggctttttctgcttcggctttattttttgcctcttcctcagctttcttctttgcttccgcttcctcctcctgcttttctttttcactcaaatcattctgatatcgttcagctgatttgactgttacatccagctcggtgagcgagctaaagaacgtcagatcaatgaaattgccttcgctgtcctttgcactgtagtcaccagatgtgctcttataatcttcaacgaagccgctgtccttcaccttgttgagatagtccgtatatgcggcatcatctacatcacacagcttgatattcacataatcggcatcgtcggtccacacgtaccccttcagactgtttggtttcggagccttcgccccaacaccagcgctaggccaactaatgggcttacagaatggatcatcgtcggaagacgaaggggaactcgacgacgatgcttccttcatactgccatgcgacttggaaccgccagccgcaccgactagcgagagagtcagcgctaccacggtgacacctgcggcaacgacggtgagcatgcgaccatgttccctacccggttgtgtcttcgtataggccagcgcacacagcaccgcggcgaccaccgcgaagataatgcccaccacgacgggagggtgcatgccgagagacacgaatccgaaaatgaggaacactgcggacacaactgccgcggcaatcgccatcacagaagttttgcccgtattggtgtcggtcagcatcgcgacgaacttattcttcgttccctgcgccggatttccgccgttgccggcagcggccggaacgggcgcctggaacgtctgcgtcggctgattctgggcgtcgaatacgggggtctgctgcggcgcagactgaaccgcaccttggaccatcagctgatcaccgaggtccttgtagaatttcgccaccgactcctgtgctttatcgcctccatcgatcggtgccgtcaccgtcaccttgcttgaacccgcggcatccccttctgcgaccttcgcagtgaataatccgttgattcccggcacactgaacgtgacagtgcgctcatctgcatttcggctcacgacgtccagcactgcgctgaattgaagcatctgttccatggcggcgtaggtgctctccaccgacgccatatagatttggtctgccatgattcccttccgttgttcgtattggtgatgtgcggcggtgagggtagttccgctccctcaccgcctgctatttgatttgcatctacgcgaatgccacgctgcgctatctttccgttttcgcgtccgtcgattgccctgaattcgtctgctggcttccgtcgcctgagatgtccttctccagctcacgggccacttcgtcaaattcgcgtatacctcgcagaatcatgctggctatctgggcaaacatggctgcattcctttctgacgaggtggttcgaacggccggttggaccgccaagcccagcgggcttgcattcctcgtcatcaaggggcatgtttttttcgcgaatccttcctccatctgcatgaatgcccgaaatttcaacgattccgacgagttgcttcatctggaatccatttaattcgcaactcaatatggtgtcaatgacgtataatgttataaattagacgttgagttgaaagaaaacatgtcatgtatggtatatctcaatctaatatggagatatggcggagccgtttgcaggaacttatggatgcccacgaactgactcaagccgcattcgtgagcgagctgaacaagcaatatctctcacggttccatcaaaaagacgtaagcagatggctcaattcgggcaataaaacctccaccggcacaatcggattcccgaaatacgaaacgatggcgatgatcgccgacttcttcggggtcgatgtcggctatctcaccggcgagacggatgagacgagtttcgatctggaacatgccagtgaatacttgggaatgagcggagagtcggtcgcggcgctccggggatggatcatcggagaggatgcggattcgcaaatgcgcaactatcgatccgagacactcaatgcgctgttcgaatcacccaaattcgcgagcgtcgcttcgaaactgttgacgctgcatgagatgtcgacactctggaagagcaacccggaacggttcaacacgttgatggaatcgctggcctccgacagtgatttgcctgacgacctcacattccagctcatcatcggcgcattctacggaatggcgagcgagtccttctcgacactgctcaaagacgcctaccccacccccacggagcaggcaactgcataatctgcgaataaaccagaacccctgccaccattgttatgtcacatgactgtcgccgcgttattgactcatacgatagacttcctgccattacgcacgcaagcgttcactgcccccacagattaaaatacaaggagaaaggcagatgcacccatctacaccggagaaaccatcgacaacacgcccaatgcgtcgagccgaccgtgaagttcgctcgttcgaggagataattgacatcctgcgcaactgcactgaagtgcgtgtggcctatcaagatgcgcagggactcaccatcgtaccggtcaatttcgccttcgtctacaacaacgatgattcctcccataacctgcgtctgctcatgcattcggcgacgcaggggcgcaagatcgaggcgattcacgcatccggcaacgcattgccggtcgcattcgagatggactgcgactcgttgatctataccggtcgcacaccatgcgccacctcgacggcataccgttcgatcatcggcaccggagtagcgagcctgctcaacgacgagcacgagaagatcgacgcgctgaaactgctgatgaagcaacgcacggacatgcacaacgtagagctgctgccgcgtcaggtgagcaaggtcgcggtctggcagattatctcgaccgagttcaccgccaaggcgcacccgttgccatctgacatgcgataggactaatcgcacacgctcattcacccacaacagcacaaggccgctctgaggttggctaatcaaccaatgattagccaacctcagagcggcctttataaacagcatcccctaggaatctagcagctcagcagattcccccaaagatccaacagcacgcccctgcaatctcacgaaccctttggggtttggaatgtgaaattaagcttcgcctctggatttacacccatgacgatggaggcatagaacgacttcgcctgctcttcgagcagatccctgttcgaatcgacatattcctgcttcgtcttctcagtgaggatgttattgatcatgtcgagggaatctatttgttgggtaccgaagcttagcgcgccattctgctcgacgatcattcggtattcgggatggtcgtagccgatgaatttgaattcaggaatttcgacatcgaacgtgttcttgcccgtttccttaatggaaacgtcctttccttcgaatccaagcttcgcgtcgaacgtatattgaatgaaccgcgcccgctccgtaccgggaatctccatattgaagaaatggcttttgttctcctgcgatatgatgcccgtaataccgagccgcaacagtgccacctctttcgtccgctccatggagcgaattacctgggtatcagaggtacccaccttctccttcaggaacgctggcatcgttcccgggaacagcgagtagaaccccaacatgaggagacatccgaccaccatgcaggacaacgcggcaataacaacaccggcaatcttccatttcttcgaaatcgccggaatcgacctcccggcatcattgtttccatccacctcgccgacagcctttctcttgcatcacctaccctgaactactctatcagagaaattcatgtcgggtcacattagcaggagatgttggatgagacatcctacactcttacagaagcacgatgcgttcgcaagaagagggatgtcgccgggcatattactcgattactccccccgattcatgaacgcggccttgaccaattccacgatcatctcacgcatgtccttcgcatcgccggccttggccgacgcctgcgccacaccgctcaccttgccgaggaacccttcgccgaactgctcctgcatcagattctgcacccaggtgacgtcgttcacgctgcgcttgccgctgtacacctgctcgaaggctatgacggcaccctcaccgagtgcggcgatgatgctcgccgccacaatcgcattgagcacactggccgcgatgttgacgcccggaatcgatttcaccgcgctgattgcggaatgcgccaccacgcttgccgtgcccacctgcacgatggaatccaggaactgcttcgacccttcatccttgtctatgccatacagtcgcgccaggccatgcaactcgcccagttccagcggggagagcaccaaggagtcggcgattggaatcggcacggcgcccactgtggcacccgccgccacacaagcgccgatcagaccttgcgcgagcactcgtttgcgggtgagtttgaacgccatgagatcatgcgagccaccgcgcatcccctccggcatcgccttcatcgtctcgtctatgagatcggagattccctcggggccggcgaacgcggtttcgtcgatcacataggtctgcgccaccacaggtatgatcgcgcgcaggttcctctccatccgctgccccgcgaacgcctgccgcaccatctgcacattcagctcgcggtccggtttcgaatacgatttcgtgatcacggtgatgatcggcaccgaccgccacatcgacacggccgtggacagattccgtattgtctccgggaacagctttgccgctgtcccgtccacgcagaaccagatcacgtcgatcttgttgtgctcatgaccttccttggcgctcgccttcgaccatttgcgcaccgcatgcaccgctctgaggcttttgatgggagacggttcgaaccctattgaatcgatgacccggaacggcaccgttgggctctcatagacggcgagctcactggtggtgccccgcgtgccgaagctcgttttggccacagtgtcccctatcaccgcgttgatcaacgtcgacttgcccacacccgagttgcccaatacaagtacgttgcctttgatcgcattctccgtgctcagcgtcgtgttcgcccgcacgtcgatcacattgccattgtcgtatgccatgacgccatcataggcacgcacgaatgcgacgccgtgagcgcaaagcaccttcatgccgactcagcagcgaatgtccacgatgttcaccagggctatacgtgtgccatcctccataacgatgaccctgcgcatctggtcgaatcgccgcacagccccttccgccgtcatatactcgccggcatctctgccgccctccggctggaaataggtgatggatgcatagggatgcgattcgagttgaccgattacctcaacaagacgatcgttgagtgtctctctttcgtcatcggccaatgcaatgcgggtgcagggcgtgctggacacctctctcacgcgctcgtcgtgccccttcaacgcggcgaacggcatgaactgcaccgcgcgttccaagttgctcatatgccggtgcttggtggatcggtgatgtggcaggtcgatgatgtcgtcgtagcggtgcaggttctcgagcgtcatgccgcatggcctccgatctgcttgctacgttccataccggtcgccccctcatcgaggttcacgcctttgatcaccgatgccgcgccgaaccggctgcgcagtgcgttgacggtgcgctgcagactcagttccttgcgatctgccgtagcctgctgctgtgtttgcgagccctccagatcctcgaacagactcggctgctcgaaggtctgggtctcccccagcatacgaacccggccggctacaaccgtgaggcgtctgacatacagccgcgaatccgcaatgcgttcgaaaacatccaccaccgcctgtcgaatggcagtggccgatgacgtgaaccgccccagatcacatgagccatgaacgcttttgggcactggtctcccatagtgatccttgcctacgggcccgaggtaccggccgtccataagactctccctgtcgaatcccactgtcagcacgacctggtccgtcaccgcccccttggcagcgagatcctgcgccaagcagtccgccatctcactcgctacggtgtgggcctgtgtatgcggatagggacgcgcaagcacctgacctatgctcaggctggaattctccggcgtatatgccttaatatcggcgattgtgcatggctcccaaccccaagcatggtcgatgagcgtttccgcattcacgccgaagaacctgtagagcagatcctcgttgtaatattcgccggcccttcccaacgaacaccgtgcaatgtctcccatggtcatgattccctgccgctccaatttgcgggctatgccacggcccaccctccagaaatcggtgagaggccggtgggaccacagcagttcgcgatacctgcgttcatcgagttcggcaatgcgcacgccgtcctcatccgcggggatgtgcttagcaacgatatccatcgccactttcgccaaatacaggttcgcgccgatgcctgccgtggccgtgatgcccgtctgctcgagaatgtcggccacgatgcgacgtgccagttcatgggccgagcacccgaaatacttgagatatttcgtgacatcgatgaacacctcgtccaccgaatacacgtggatatcctctttcgaggcgtagttcaaatagatgccgtagattttcgcactggtgtccaaatagtatgacatgcgcggtttggcggcaatatattcaatgccgagccgtggatcagcctgcagttgcgccgcgctcaccgacgaccccgcaagcctgtgccccggcgcacgcagacgccgctgctcgttgagcaccccgacacgctcctccacttcgaacagtctggcgcgcgaccccaacccgaacgatttcagcgccggcgacaccgcaaggcatatggtcttcgacgtacgggacacatccgccaccaccagattggcgtcaagcggatccaggcccctcgccacgcattcggcggatgcatagaacgatttgagatccaccgccaagtatgttcgctctcccataccacagattatcgaacaaacgttcgaatctgtcaatcggcaataggcgtcacaccaaaggggcgcgatgcatcaacgtcggcgtccgcgagtccagcatgtgaatgggcgcaccgtcacaattcgccggaaatccgccatttccataaaatccgagtttgccggtgtagccgggacttgctagggtttatctcgtagcgaatcccttattccagttgtggaaggagcttcggcttgtctgcagaactcgaagagatccatgaggaatgtggcattttcggcgtatggggacatcccgatgccgcacgcctcacttacttcggattacacgcattgcaacatcgtggtcaggagggtgccggcatagtctccaacgaccacggccacctggtagggcaccgcgggctcggattgctcacgcaggtgttccaggacgaaaaagacattcaacgacttcaaggcgatgccgcaatcggccatgtgcgctatgcgacggccggctcgggcggcatcgacaacattcagcccttcgtgttccgcttccatgacggcgacatggcgttgtgccataacggcaacctcacgaactgcttctcgctgcggcgtgcgctcgaagacgaaggcgccattttccattcgaactccgacaccgaggtgctcatgcacctcatccgccgttccatgcgcagcggcatcaccgacaagctgcaggaagcgctcaacaccgtgcacggcggctttgcgtacctaatcatgacggaacatgagatgatcggcgcactcgatccgaatgggttccgccccctctcgctgggccgcatgacgaacggcgcgtacgtgctcgcctccgagacctgtgcgcttgacgtggtgggtgcggaacgaatccgagacattcagcccggcgagatgatcgtgatcgacgacagcggctaccgcacgcagacgtacacgagccgcacgcagctgtcaatctgctcgatggaatacatctacttcgcccgccccgactccgacatctacggcgtgaatgtgcactccgcaagaaaacgcatgggcgcccgtctcgcacaggagtccccagtcgatgccgacatggtgatcggcgtgccgaattcctcgctctccgccgcctccggctactccgaggaggccgggttgcccaatgagatgggtctgatcaagaaccaatacgtcgcccgcacattcattcagcccacgcaggcattgcgtgagcagggcgtgcgtatgaagctttccgcagtcaagtcggtggtcaagggcaagcgcatcgccgtcatcgatgactccattgtgcgtggcaccacgtcgaaacgcatcgtgcagctgctcaaggaggcgggggcggccgaagtgcacatgcgcatcagctcgccgccgctcaagtacccgtgcttctacggcatcgacatctcgacgacgcaggagctcatcgccgcgaagaaatcggtcgaggagatccgcgagttcatcggcgcggattcgctcgcgttcctctccgtggacggcctgatcgagtcgatcggcctgcacgccgacgccccgtacggcggcctgtgcgtcgcgtacttcaacggcgactaccccaccgcgctcgatgattacgaggagggcttcctcaactcgctcacccccgaagaccgcgtgacattgcccggctacaacggcaagaagacgatgtacgagggcaccgagtacacgatgatgcagaagccgttcggcgagcatgcctcccaggaacccaccgagtatctcgtccccaatatctagttcccagattttcccgatacagattcatacagattcatcaatcgacttgccgatttcggcgaacagaaaggtcacaatgccacaagcatatgaaaacgcgggtgtgagcgtcgaagcgggctacgaggtggtcaagcgcatcaaatcacacgtcgcacgcaccaaccgaccgggcgtggtgagcggcatcggcggcttcggaggcctcttcgacctcgcctcacttggctacaacgaaccggtgctcatctccggcaccgatggtgtgggcacgaagctcgtcatcgccaagctcatggacaagcatgacacgatcggcatcgactgcgtggccatgtgcgtcaacgacgtcgtggcgcagggagcccagccgctgttcttcctcgattacatcgcctgcggcaagaacgacccggcggtgctcgaacaggtcgtctccggcgtggccgacggctgcgtccaggcgggcgccgcgctcatcggcggcgagaccgcggagatgcccggcatgtacgacgaggatgagtacgatctggccggcttcaccgtcggctgcgtggagcgatcgaagatcgtggacgggtcgacgattgaggcgggcgatgtgctcatcgggcttccttcgaccggcgtgcattccaatggtttctcgctggtgcgcaaggcactgttcgagcaggccggctataccgtgcatacgcgtcttcccgagctggacgatcgggaactcggcgatgtgctgctcacccccacgaagatctacgtgaaggcgctcatgccactgttcgaggccaatctcgttcgcggcgtcgcccacatcaccggcggcggcttcatcgagaacgtgcctcgcatgctgccggagggtctggccgcctccatcgagcttggctcgtggccggtgccgccgatcttcgacgtgatcgaaaaagcgggcgatgtggatcatatggagatgtacaacatcttcaacatgggcctgggcatggtcgtggccattcgccccgaccgtgttgacgaggcgatgaaccttctcgagcatgcaggtgagaaggcctatcgcgtcggccatgtgatcgaacaggtcaacgaacgcgtcgacctggcctgagaccaaacccatactggcacagtttccccaaggaagtgaaaaggaatatgaaggttcttgttatcggttccggcgcacgtgagcatgccatcgcctacacactgctcaagggagcaagcgtcgaggaggtcaccgtcgcccccggcaacccgggcatggagctcgacggcatccgcacgctctcgctcaacccgtcgaatcaggccgcgctcatcgatttcgtgcgcaacaacgactacgactgggtgttcgtgggtcctgaggtgccactcatcgaaggcattgtggatgcgctggccgcggccggcatcaaggcgttcggaccgagcaaggcggccgcgcagatcgagggctcgaaggatttcgccaagcgtctgatggaacgccacaacattcccacggccgcataccgcaccttcgacgatcttaggagcgccaccgactatgtgaacgagcatggtgcgccgatcgtggtcaaggccgatggtctggccgccggcaagggcgtcacggtggcgatggacgtcgaaacggccttggatgcgttgaacgacattttcgtggaccaccgtttcggctccgccggcgcccgtgtggtgattgaggattacctggagggacaggagttctcgctcatgagcttcgtgaacggcaccgaattctggcccatgccgatctcgcaggaccacaagcgcgcctatgacaacgatgaaggcccgaacaccggtggcatgggcgcctactcccctgtgccccagatcggccaggacgtggtcgacgaggcccttgagaccattgtcaagccaaccgtcgaagccatggcctccgaaggcacaccgttcgtgggcattctgtatgcgggcctgatcgccacggccgacggcccgaaggtgatcgagttcaacgcacggttcggtgacccggagaccgaggtgattctcccccgtctgcacagcgatctcgggcaggccattcaggccatgcttgatggcgaagcgcctgagttcacctggcttgaggagggcacgacgctcggcgtggtgcttgccgccgacggctacccgaccaatgtgctcaagggggccaaggtaccgcagttcaagaccggtaccgactcccatgtgttctatgccggcgtgaagcgcgagggcgacgatctggttgccgactccggtcgcgtgctgctcgtcgaagtgagcgcagacgacattccgagcgctcggaagaaggtctacgaaattctcgataacgccgacaccgcaggcatgttctaccgccatgatatcggcgccaaggctttgcaggcatagcacgtggataggctataacattccggcagaccgttgccggccagttcattcttgaaggattggactgaccggcgacggtcattcatatcaatgatgttccgtatcgttttcagcgcattacagaacgcatgcgagtcgcttccgtctctcactatggtaggaaaagacaaccgatagaggagcggaacgcatatggcaggtatcaaggactggttctacgccatcgatgtaatcagcggctggttccccgtcaccatatggacactggtggcgatcggcatcgtcgtattgctcatatgccagaggaaaggcgagtcgcgcaagcgcttcctcaggcagctcggcatagggttgctcgccggaatcgtcggtctcgccgcgacctatgtgtgttcggatgtgctcctgctgttcggggtctcgctcggctggccggtgatcatcgcaatcggtgtgggcgtgttcctgttcgcattcatgatcgccgccgcggtgatgacccatggctggctgcgcgtgctctccatcgtcatgatcccggtcacgctgctcgccaccgcggtgcgtgcgaacgcaatctatggtgaataccagacgatgggcagtctattcgattactcgccctacccgcacatctcaacgctggatctttcgctcaacacgatctcggtacgtgaatggaacgagcaggcggtggcaaagagccgcaacaccacgcagattccccaatcgggcaaactcgtgcatgtggacatcccgaatccgaaatccgggttcaaggcgcgcgaggcgctcgtgtggctgccaccggcggcctttgccaagcacccgccgaaattgccggtcatggtgatgttcgccggccaaccgggctcccccacgcgtttcttcaccgcaagcaacgcaatcgaggtgttgggcagattcgccgccgagcaccatggtctcgccccgattgtggtcagccccgaccaaaacacggctgcgacgcgcaacagcctgtgtgcggacaccacgaaatggggcaaggccgaaacgtatcttgcacaggacgtacccgattggatcaaagcgaacctgcccgtcaacgacaaggcatcacagtggacgatcggagggttctcgcagggcggcacatgcgcgacgcagctggcgccgaaccatccgaacatctacggcaatgtgctggcagtagatggtgaggtcgctccgaccgagggcagcgtagaccatatggtcgaggcgtatttctccggggataaggcggcatatgaacggcaggtgccgcagaatgcgattcggaacaatgcgccatcgaaacagctcatgatccttggtgcgggcgcacgcgacggcgaatccgtcgacaacatacgcaagatcggcgacaccgcccgggaaaacgggtggacggtgttcagattcgcagtgagcaactggggccacgactggcatgccgtcaatgccgtcttcgccgtggccctgccgtatttatgtgaacgcatgggattgggcaacgagaatgtgcagttcccgaccgattcagaagtgaaggagatatcgtgagcgcaacggattcgaatgacggcgtcgccagcgggcagacgcaagcggcggcaaaaccgccgaccagccccaaacctcccaaagcgccgaagcggtatgcggcgcaaccggtgagcaaccagctgctgaacgacatccggcgttggatccacgagcagagcttcgccctgtgggtcaccttcggcttcatcatgatcaatgtgtgctggtgggcatggtacaacatcgagcaccacaagatgccacgccatgcgctcaccacgagtctgcacgagttcaatgtggggcatctcatcgcctcgctgttcctcaccggttcggtgttccagatgatcgtggatgcgctgctgatcctgttggtgctgtgcttggcggaaccctatctcggcaagtcccgcacagccgccatcagtctggtgagcgccgcatccggcacactcgtaggcctgatcatctgttcggcgatcagcgcgatgctcggcgaacgtgcggaggtgctgaacatcagcttcacgctctcccccgtcgtgctggtgatcggcgcgctcatggcggcgacggcgttctcataccaattgtggcgcagacgcatacgcatcatcggctacacggccatcatggtcgtggtgctctacggcggcaatcccggcgattattgcgtgctgttcgccgcgatcatcgggcagatcataggccgtgcgattgccggcaagccaatcgaagccgagcagtggcattggcagtacagttcgtcgcaggagattcgccgcatcttcggcgcgatcggcgtggtgctcgccttgggacccatggtggcgacttcgtcgcgatcccatgccggccctctcgtgtcggtggcactggtgctcagccccgaatcggtgaacaccggggtgttggcggcctgcatgcacggccatgtggtcgacggctgcctccaacagtattcgctcatgcgtgccagccaaccgggggacgtggtgcgatcggtgctgccgctgctggtgatgctcgccctggcatggggcatgtggctgggacggcgcaccgccgcgatcagcagcatcgtgttctatgcggcgagcgcgttcttcgccatctcctactacctgttgccgtattcgttggatgatcagctgcatatcaccatgggcaacataccgcgcatgattctcgtcaatgcgcttataccgctcatatacgcgattgccgtgatcatagagctcccgcatttctccattcgcacgaaaccgcggacgcttcgccgctgtgtggctgccattgtgatcgccttcgtcgtatgttcggccatctacctgctgttcgcctgtttgcgacctcaggatttcacgccgcatccgaatgtgggcatggtgctacgcgagtggcctgcaaggttcctgccgatcgggtatctgacggattcgagcatctcgttcatcgccgtcaccccgttggcttcgcttgttctgcagggcgtgggcattgtgttctggatcgtgctcgtcgtggtctccttcgcgtggctcaacgcgtcaatcgactatgaccacaaggcccatgcgctggccgaggaactggtggaagacggcggcgagtccatgagcttcatgacgacgtgggagggcaacgaatactggctgtcgcccagcaaaaggtccgctgtcgcctaccgtgtgctcaaccacatcgcattgaccaccaccggaccgttcggcgacccggatgaatggatgagcgatatggacgagttcgcccgctactgctccgaccattcatggtccccggtgttctacgccatccacgaggaggccaaggatcacctgcagcagctcggatggcactccattgtggtgggagacgagatgctcattgacccgcaaagctggaagaccaccggcaagaagtggcaggacattcgcacggccatcaacaaagcgaagcgtgagggcattgtcgatgagatgagcacctacgatgaggcgccccatgaggtgcaggtgcagatcgaggagatttccgagcagtggagcgaaggcaaggcgctgcctgagatgaagttcacgctcggcggcgtggaggagctcaaggacccgcgcgttcaggtgctctatgccatagattccgacggcatagtgcaggcggtcaccagctggctgcccacattcaacaacgggcgcgtgatcggctggacgctggacttcatgcgctaccgttccggaagctacaacggcatcatggagttcctcatcgcacgcatggcccagcgcatgcatgaccagggtgtggccgatccgagcaaccaggtgcagttcgtgagcctgtcggcggcaccgcttacgggactcaagaacttcaccgacgcgaagagcgacgacagctcgaatgtcgatggcaccacgatgctccagcattcgctcgcgcttgtggcggatctgctcgaaccggcctatgggttcaagtcgctctacaacttcaagaagaagttccagccgatcgagcgtccggtctacatcagctactcggattccgcattgcttgccaatctgggcattgcaatcatccgcgcctacctgcccgccctgacgttcagggatgccctgggcatgctttcgagcttcaaaccggccaagccgaaggatgacgggaaggcaacgggccatgggcagcctgcaggcagcccacgcgatgctgcacacgagtccgaggtacatgacgccaaaggtggcaagccggtggacgaccaagctggcgaaccacggtaaaccatcagtgttctgcgtaaaaggggacaaatacatgcatgtatttgtccccttttacgcagaacacgcgtgagctggcgctaaagtctgccgtgaagtgtcaggctgcacagtcaccgcgtgcggcacggcagtccgcgcacaggccgaacacctcgagcgtatgcgactcgatggtgaagtcatgttgctgagccacggactgcagccacgcctcgctcggaggatcgatctccaccgttctgccacacgacacgcacatgaggtgatggtgatggccgccggcgttgcacagtctgaacagctgctgcccattgagccgcacggtgtccacctgcttggcgtcggccatcgtccccagctggcggtacacggtggcgagtgcaatatgctcgccggcgtcctcgagccgcgcatgcagctgctgtgcggagatgaagtcgtccgcaccctgcaacgcctcccgaatgacgtccttctgccgtgtattgcgctcgcccatgttcctcaccttgcgaatccgtgaatctgtaccagactgttcaacaatcccagcagcctgtctgttccaatgactgcgctgcatcccggggattctcgcacagcacggtgatgtgccccatcttgcggttgaacttggcctcggccttgccgtagtcgtgcacatgccattcgggatgcatcggctccacggcctgcgtgggtgcgatatgctggccgagcacgttcaccatgaccgcggggctgagcagacgcggtgtgggcagattccagccggcgatgccgagcacatgcatgtcgaattggtcgaaatcgcaggcttcgatcgtgtaatgaccggaattgtgtgggcgcggtgcgagctcgttgacgatcacggtgccgtccgccttgacgaacagttcgatggcgagcgtgcccgccaatttgaagccgcgcgcgagctcgagcgccagttcatgcgcggtgcgcgccacctgttcgtccacgtccgccggggcaagcgtgagatgcaggatgttgtcgcggtgaatgttgcgcacgatcggaaacgtctggtaatcatcgccgttgccgctcaccagaatggaggcctcgaacgcgaaatcgacgaacccctcgagtatcgcctgcgggaagccctcatcaggccagacctcggccagatcgtccggtgtgcgcaacacgatctgcccatggccgtcataaccgccttcacaggtcttgagcacggccgggtagccgatctcggcgagcgccgcgtcgagctctgcgcgtgagcccaccggtcgccatggtgccgtggcgatgccatggtcattgatgaacgtcttctcggcgatgcggttctgtgtcacgcgcagcaggtcggtgccctgcggaatcgccacaatgtcgcggaccgcatccaatgcgtcggcatccacgttctcgaactcgtaggtgagcacgtcgctgcgttcggcgagctcgtgaatcgcatcctggtcgtcgtagtcggcgacaatctggaagtcggcaacctgcgcggtggggcaatcgggtgtcgggtcaagcgtgccgatgcggaagcccatgtatttcgcggcaagcgccatcatgcggccgagctggcctccgccgacgatgccgatggtcgcccccggcagcagacgcgtgatctggccgccggtttcgtcagataagctcggcattggactgctccaccttctccttgagttcgtcgcggtatgcctgcagtgcgtccgccagacgctcgtcgttcatgctcagcatgcttacggcgagcagacccgcgttcgtggcgcccgaattgcccacggccgtcgtggccaccggaatgccgcccggcatctgcacgatggagagcagcgaatcccagccggagagcgcgtgggagcgcaccggcacaccgatgaccggcaatgtggtctgtgcggccaccataccgggcagatgggcggctccaccggcaccggcgatgatgatcttgagcccgttggcgcgagcattgtgcgcgaattcacccatgagttcgggggtgcggtgtgcggagaccacttgcttcatgtacgggacctcaaagcggtcgagcatctcacaggcgtacctcatggtctcccaatcgctcgccgagcccataatcactgccacttgcggcttgtttgcggtcatattacctccagcgcatgtgcgcccgcacccgatccgtgtgggaggcgcgcggctcaccctgacttgttcactgtacgccaaaggtgtgtcgcggcttgcgcgagcactccttttgcggcattatctggcatgattgatgccttatagctctcacactataatatgtgcatgaagttgaccatatgcgacgcgaatgttggaatgcccgcatattcttgcgaacgcctgcccggcggaatagagagggatcactaatctcatgacacacgaccttctgtctcaagtgctgtcgccttccgacgtgaagctgctggatcccacgcagctcgatgccctgtgcgcgcagatccgtgagacgcttgtcgaatacggcaagaggtacggcggccatatcggttccaatcttggtctggtcgaggcgtgcgtggcattgcatgtcgtgttcgaatcgccgctcgacaagatcgtgttcgacgtgtcgcaccaaagctacgtgcacaagatgctcacggggcgcgccgaggcgttccgcagggccgagctgttcggcacggtgaccggtttcacgaacccaggggaaagcgagcacgaccatttcgtgctcgggcacaccggcacgtcgatctcgctggcatgcggcatggcgaaggaacgtgacatggtacgggctgcggggggcacggcgcagacgaacaatgtgatcgcggtgatcggcgacggcgccctcagctcggcgattgcgtttgaggggctcaacaacgccgccgagcaaggcggcaatatgatcattctcgtcaacgacaacgagatgtcgattgccgagaaccatggtggcatgtatgcgacgctggccgcaatgcgtgagtcgcacggcaggggcgaacgcaatctgttccgcgacttcggactcgactaccgctatgtggagcacggcaacgatgtgcatgagctgattcgtgccttcgaggaggtgcacggcatcgaccatccggtggtcgtgcacattcacacaacgaaggggttggggctcgacgccgaggatgccgcacaaggcgtgtgcgaaggccgctgtgaggcgaaccattggcagaatccgctctcacgggcagattcttcgcttggcgcccgcaaatactatggcggtcttgccatggcgtcgctggaacgccgtttcgccaccgaaccggggctggtggtcatctcgcctgccacgcccggttccaacggcatcacgcaggacttccgtgagcgcgccggcgcacattatgtggataccggcatcaccgaggaacatgccgtggcttttgcctctggcatcgccaaggccggtggcagacccgtcgtggccacctccgccacgttcttccagcgcaccttcgaccaattgcagcaggagctcgccctcaacgacaccccggtgacgctcctttccttcggcgcgggtctctccgacgccgacaacacgcattcgggcgccttcgacatcgcgatgttcggcaacattccggggctgacctgcctggctcccacttcgcgccgcatgttcctcgacatgctcggctggtcgacgtcagcacgcaacacgcatccggtggtgatccgcgtgccgggcgacacgattctcaaggatgagcgtgccggcgaactcgacccggaggcatcgctcgccccgcagaagaccgatctgctcaaaccctggttcggctatgacgtggtctcggacggcaccgacgtcgccgtgctcggcctgggcaatgcgttcgcgaccgcacatgccgtggtcgaacggcttgcagactcctcccctgccatcgccgccacgctgatcaacccgttgcagttctcatcgcttgacgagcagacgctgcgctcgctcgccgaggatcaccgcgtggtggtcacgctcgaagacggccagctcgagggtggctggggtgagaagatcacggcgttctacgcgaacatgatgccggattgcaccatgcgcgtgctcaatttcggcgccgacaaggagttcaccgaccgcacgccgctcgccgagctcaacagccgctatggcatgaccgtcgagtcgatctgctcgcgcatccacggactgctcgactaacgccccatacatacgaaaatgcgaggattccatggaatcctcgcttgaagtgaccccggacgggctcgaaccgtcgaccttgagattagaagtcacatgctctatccagctgagctacggggccaaaccgtacctagtatagccatagggctgcacagcgcacgccggtcgctctaggcacggcggcgaatctgcttggcggcgagcatcgcgaagttgccgcccaccgccacgagcatgccgcacagcactccgacctcccgtttcgcaacagcaccatcatcacgccaccatccgcatactattcgagaatgcagctcagaccgaacagcacaagtacgaacagcgcacagaagctcgtgtactccttgaggtacttgcctttttggttgggatacatcttcgtgaagtgcttgtaggtgacgagcgaagccatcgaggcgatgagcgtgcccaagccgccgaggttcgtgccgatgatgagtggcacgtaggcgttcgagaagccggcgagcagcagcgaggtcggcacgttggagatcacctggctgaacaggatcgagacgccgagcgggtgcacgcccacgcactgttgcgcgagctgggcgaattcgggcacacgcctcatgttgccgatgaaaatgaagaacatgatgaacgtgagcggcaggccccagtccgcgtggcggaacgagcggcggtcgcacaccatcatgacggcgaacacgaccacgcacatgacccagagcggaatgaggtcgcccacggcgagcacgcagacgatgaacgtgatggcgtagacaatcacacgccagccgccataaccggcgccatagccggtaacgtggatctcgtcgggctgcggtttcgtggaatccggcgcaagcacgccatgctcgatcgatttggagtccatgccgctgatgccctcgagcctgcgcccgcggaacacaatgcaggtgatggcaatgagcatcgccgccgagaccgccgtatagggccccatcaccgccaggaaatgcccggtggacatgccggtgagcgccttgaagtagaggttgtgggcattgccgatcggcgtgagcatgctgcccgtgttcgccccgatcgtcatcaatgtgcacacgagaatcgcgcggtcctccatcttcgccatcttgagcacggcgagtgcgaacggcacgaatgtgagcaatgcgacatcgttcgtgatgagcatggacgagaagaacgtgagcgagatgaacgtgagcacgagtccgcgtgcggtatccacgtgttcgagcagcttcgcgccgatgatgcggaacacgcccacgcgctgcagcccgcatacgacgagcatgaggcagatcagctgcgcaatggtgctcacatgcacgtattcgcgatagtgccagtctgggggaacaatgaaacaggaaatcaatgcgagcagcgtagccactatgagaatggtttcgccacgcaggaatgcacccacacgatgtcgcattcactcctccacactctgtcgaaaacgttactatcctacacgaaataccggtgccacatgggatttcgtgcacggttttcccgaccaaatacgtgtggatgacgccatttgcacttgcaaacattgccgttcgttgccgaccgttttgcccaaaaaagttttccacagagtcaaaacggtcatggccggcaccggctcggtccgatgcatcgactcagccggccgcggagccgaagatctgcgactgcaggtccttgcgctcgcgctcgacctcggtgatcgcgccgaacaaccggatctggtcatgcgtgttcgtcgcacgactcgcctgctggcgcaggatgccgattcttcgcatgtaacctgtgtcgatgagactggcggtgagctggttggcatattgcctctgctccgcgcttgcctcgggcatcggctgggcggactggctgcccggctcctgttggcctgtctgggccgcattgccgttcgccatgttctggggcaatggcagattcatcacggccagctcggtgatgaccggtgccagcagcgggcctcccgccttggtgagcgcatggagccactgcccgggcgacgtgccgggttccggaaggccaccggcggcctccaccgcctcgaacatcgtctggaacaccggcgtggagaagcaatgcacggtgagggccttgaacagctcggcgttgacggcgcgcggaatctgcaccagcgtggccatgaactgcatctcggtgatgaacacgttgtcgtcgatgcggtggaaatgctgggatctcgcattgccacgctcgatttcacgcatacgcgcctcgttcattgggggctgttcacgttcgcgttcatagttgcggtcgtaaccgcgttggcgtgacgcataggcgtcctcattcggcacatgctgcgcacgtcgtgcggattgcacctcacgctgcaggatcgtcagatcgatgccgatcctgcgggcggccttgcgcgtgtagaggtcgagcaggctcttgtctttgatgcgcgcgatcaggggcgccaccgccttgacggcacccatctggccggtgccgtattgggtgtcgaacttgcctatggctacgtcgatcacgaagtcgtacaacggccgggcgttgaccacgagggcgcgcaaggcgtcgtcgccgcgctcgatgcgcaggtcgcaggggtcgaggttgttgtctgccacggccacgaaggtctgtgtctggaacgaggaatcaaggccgaaggcgtgtaatgctgccttttggccggccgcgtcgccgtcgaaggtgaatacgatgcgcgagctcagcggttcgccttccaccctgagcggaccggtgagctgcacgccgccaagcgaatcgtcggagatgagacggcgcacgatcttcgcatgctcctcgccgaaggcggtgccgcaggtggccacggcggtgtccacgcctgccagatgcatcgccatcacatcggtgtacccttcgacgatcacgacctgacgtttcttcacgatctgcggcttggccaggtcgatgccgtagagcacctggttcttgtggtagagctgggtgtcgggcgtgttgatgtatttcgcggcgatcgaatcgtcgtcgtagagcttgcgggcgccgaacccgagggtacggcccgtcgagtcgcgaatgggccatgtggctcgtccgcggaagtaatcgtatatgccccgggctccttggcgcgcgagcccggcgtcgagcatctcctgctgggtgaagcccttgtcggccagatgacgcaccaggttgtcccagccctgcggcgcatacccacagccgaaccgcgcgcagtcctgctgcgagaaattgcggccggcgagcagcttgcgggcgggcagcgcctcctcggtgagaatctggctcacgaagaacttctgggcctcctcgttcgcctcaagaagacgtgcgcgcttggtgcccctatgcgagtcgttcgcaccgccggcgttctcgtaatgcagctcgatatggtacttgtcggcaagcagttccaccgcctcgcggaagtctatgttctcctgctcctgcacgaacctgaacacatcaccgccacgaccgcagccgaagcaatgccatgagccgaccgacggacggacgttgaagctcggcgtgcgctcgtcgtggaacgggcacaggcccacataggcgcccacacccgagggcttgagcgccaccgtggcggagacgatgtcgtacagatccgccgcgttgcgtacgcgctcaatgtcttccttcttaatcatcccggccatgtggcatagcatatcaggcaggcgaaggattccccagcgtcatcggcgtattttccgcagaatctgcgcgccttcgcggcgattcatgcaatggcggtgtacgggcacatcacagcagcgtgctctggtcgagcttgcccaggtccgtctcgtcgagcacttcgaacgcattcgcatacaatcgcggcacacggttgcgcaaacaggtgaagatctcatagctgatcgtatcggccgcccgcgcccagtcgtcggcggtcggctcaagatagtcctcgccgcgccctggcccgaacagctccaccgtatcgcctatatgcacacccatgttctcggcgtcgccatgcaggtcaagtatgaactggtccatgcatacgcggccgctcacatggaatatgcgcgcaccatcgcgcgtcatcacccgcaccggcgcgcccggcttgttcacgtgcttcgaaccggcctcgttaaatcccgaggcggaacggtgaatgccatccgcatagcccaccggcacaatcgccgcgctcgtgggctcatcggtcacatacacgcgcccataggacagcccctcaccggcgcccacgttcttcacggagctcagttgcgcctgcaacgtcatcgccggcctgagctcgtacttcgacggcgtgcccattgccggatccgcctcatagccatacaacgctacgcccggtcgcaccaggtcgtaatggatctcggggcggctcagtgtggcagccgtgttggcgagatgccggattcgcggttcgatcccgcgtgcatgcaggcgcgaggtgaactcctcgaatacccgaatctgttcgtcggttttctcaacgaactcgccgacggcaggggcatccgccaccgccagatggctccattggcccacgatctcaaacaccccttcgtcgaccagcggcagcagcaagtcgatggcggagtcgatctgggccaatgtgaacccgttgcgcccgaagccggtgtccaccttgatgtgcacgcgcgctggcttgccaacggctcgcgcggcctcagcaatcttctgaatcgcagtcagggtggccaccgaaaggtccacatcggctgcaatgaggtcatcgtagggagcatgcagcggattgttcacccacgtgagcacgcgggcccgatcaacgccaatgccggcattgcgcaatgcgagcgcctcgcgggcctgcgccacgccgagccacgtggcgccgccggcgagcgcagccaaagcggaggggaccagaccgtgcccatacgcatcggccttcaccactcccatcacctcggtgggaccgccctcgcgattggtgatatcgaccaagtggcgcatgttgtctcgcaacgcggcgagatcgacgatcacctgcgcagggtattcacgcagcgcctgattatagttgcgctcgccctgttcggaggaaaactgccattcttcaagtgcactcacgctcatgcacaccattgtggcctgttcgtatgacgagtgcgtaagcgggtatgcgtgggacgtggactcgcaccccacgggcccattggctcaccactcgtggcgttggtaggcgatgcgcgtcgtgtcttcggtgcggtcgatgagctggatcaggccgcaacgggcgaatccgcagctttcgagcacatgctgcatggccttgttgttggggtgtgtgtccacgcgcacattgccatagtgtttgaggcaccattcgatgcagtcgcgtgcagcatggcgcaccaggcccgacgaggcgatgcgatggatcgtcacataggagtcgttgtcgagccacgcaccttcgatcttcgcataggtcgggtccagccccgggcacagcgcgaactgtgcgagaatgcgttccttgccgcccaaagtatctgccagcaggatcgcccggtgctcgcgaatgtcttccttcaccgtctgcggcttcgggaacgcgttcccccactgcgtcggattcccattgcgcgccatgagttcgcgggcatgcgcgtagatgcgctccatctgagggtagtccttcatggtcgcgtggcgaaaacgcctgttcgtggcgtcctgcataccgtttctcctctcattcgcgaattcctgcacagcctgtatggcattccggctcacacaatatatgcgccgcctgctatatgacggcgcatatgaacattcccgggaagactcagaccaccttgcgctcgaacggatcggagctgatgccttgggccagaatgtccttcgcccattccttcgccgtgaacaggctgtggtcgcggtagttgccgcagctttcgatggttgtggcgggaacgtcgtcccacgtggcttcgttcgcgatgaactcgagcgattccttgagcgccttggcgacgtcctcggtggaatgctccccccacgtgagcagatggaatccggtgcggcagccgaatggggagcagtcgatgtagccgggaatgcgctcgcgcagcagcactgcaatcgtatgttcaatcgtatgcagcccacccgtcggaatcgcgttctcgttcggctgcaccaagcgcaggtcgtagttcgagatcacatcgccgttcgggccggtctccgtatcgatgtagcgcacatacggcgccttcaccttcgtatggtcgagctggaagctttcgaccaccggcttgctctgcgtattcggttcgtctgccatgaccgccctttccgttgtaacagtgcgtcccactcagtgtagcgccggcacccgccgtcgcttccagcacttgcccgcacatctttactaggcaatctttttttgtttatctaattattcacttcaggctgacctggtcaacagattgcctactattgtcctcaacacaccgcggttgccacaagctcttcaccgcggggcacatgcgcgtgaccgcagatagcacggatgagcctgtgaatccagaccactgccgctctgccgcggcatgccacctatacatatccgtttcatctcgcaaagaacagcacacccatggcaaccaatgttcaggattccgacgtccgtcccgtcccaaccgttacatcagcacaccgggagtggccaaagaggtccgcaagtacatcgaggactatgaccaccccgtcatcatcaccggcgtcaaatccgccgacgcgttcctcgactatacgggagaagacgagttcttcgcacccgttctgcgctacgacggttcgtcgagcgaacgcaacgcacgcgaactcgccgaacaggcgaaggcgctcgacgcggacgcaatcattgccatcggcgccggcaaactgtcggacactgcaaagaacgtggccgagatgatggacgtcgacctgatcatcgtccccacgctggcctgcgcctgcgccgcctactcgccatactcggtggactatgacgacgaacaccgcttcctcggcgtgcccgtgcacccgaggaacagcgtcgcattgctcgtcgattcagccatgatcgcccagacgcctccggagaaattcattggcggcattggcgacacgattgcgaaattctacgagtccgaccctgtgttcgcccaagctgacgacctgaccgtattcgaccagttgtcgcggcagagcgcgcgtcttgtgcgcgacacactgctgagcgaaagcgagcctgcgcttgacgcgttgaaccaaggcgcatacgacgacccgcatgtacgcacactgatcgacacgatcatcggcatcgccggcaccgtaggcggcttcggcggcgtgcgggcccgcgaatccggcgcccacaccgtgcacgacgggctgacccgcatccccggctccgcggagacgatgcatggcgagaaagtggcctacggcgtgctcgtgcagctcatcaccgaaggcaaggaagacgaggcgcgcgatctactgcccttctacaacaagatcgggcttccccactcctggaagcagatgaacctgccattcaccgacgagaatctcaagacggtggccgatttcgccgcagatccaggctccccgttccacgcggccgtccccgacgtgaccgccgaccagatcatcgatgcgatgcgcaccgtcgaagcattctgatccatacaccctgcgtgggcgcattccacccgaaacggcgaaatgcgcccacggctctattcgccataaacccgcgacatcccaaaccgagcgaatatgcttgaagtatgacattcttgattatcttcctcgtggcactggcggtcagcgcagtgggttttcaccgctacatctggttcatctcgataggctacggcttctccatcgcggccattggcaccgcgctgctcatcatgttcggcgtgcggcatgagctgacggccgtgaccgccatcatggccgcattgctggtcgtgtacggactacggctcggcggctatctgctcgcacgcgaataccgcagctcctcctaccacaaggtgatgcaacaggcaatcgacaacgggaacaatgtcaagctcccgctcaggcttctcacatgggtcggctgcgcgctcctctacgcatgcgaggcctcgccaattgccttccgcttgcagaaccatgcgggaaccgacgccgtcgccattgtgggcgcggcgatcatgggcgttggcatcatactcgaatccgccgcggatctcacgaagaaccggttcaagcagcaacacccacaccgcttctgcgatgtcgggctcttccgcatggtgcgctgcccgaattacctcggcgagatcgtcacctggacgggcgtgttcgtctccggcgtcacgatactcgacggcgcctggcaatggatcgccgcaatcggcggctacttgtgcatctgctggatcatgttcggcggcgcgcgcagactcgagctgcggcagaacaaggaatatgcagacgacccgcaataccggcactattccgaacacacaccgattctcatcccgttcatcccgctgcatagcttgagcaatgcaaagtggctcatcggctgagttggcggccacaccggaatctacactgaataaccgaaagcaaccctgcagaaacacgagggaatcatgtcgaacctcaccatccgtcatgccaacgccggcgacatcgatgccatcatggaactgttgcgtcaggtcaacgacgtgcatgcacacggtcgccccgacctgttcatcgagggcaagacgaaatacacgcccaccgaactcgcacagatcatcgcagacgattcccgcccgattttcgtcgcaaccgacaccgatagcacgttgctcggctacgcgttctgcatggatgagaaccatgcgggcgccaacaatctgcagccggttcgcacgctgtacatcgacgacatctgcgtggacgagcgtgcgcgcggcaaacacgtgggcactgagctgtacgaccatgtgctcgactatgcccgtgcacacggctaccacaatgtgacgctcaacgcctgggctgcgaatccagccgccgtcaagttctacgagtcactcggcatgagcgtgtacagatacggcatggagcagattctctaatcttccaaacgcaccgcgtgcccgcgcaggaaggcggcgagctccccggcatcgcaacggccggtgacgatgctctgcacccactggtacagctcgttgcgttccggctcctcggcatcgtctgcgcgcacgttccagccatgcatcgcgaggatcgcgagcgccatcttcaccgccgtgcgcttgttgccgtccgggaaaatatggtctttcgcgaaacgcgacgcgaaatcggagatctgctcgaacacgtcggcatatcgttcgcgcggcgttatgccgaagaacgtcaggaacgtagagccgagcaccgactgcacacgtccgaggattcgctcatccaccgcagcgggcgccgtcggcgtgatgtcgagtccggtgccgcgaatcgtctccacatacacttcgaacaccgattccgcaagcgcatccatgcgcatctgcttgccgtcgagcgcaatcggttcggcaccgtcttcggcattgcccatcttccgctccccttccatcacgaatgctccagcaatctgagcgcattcgggtatttgcgctccaccccgtccacacaggcggccagcgtgcgctcactcacttcgcgtcgcatgtcggcagagccggcgatatgcgacacggaaatgctctcatagccttgctcacgcgccgcattccacgccccatccggatggtttgacagattcagcagatcggccgccgtcagccaaccgagctcacgcatcacgctcgcgacgaggctctcggtgttctcccccagcgctttgacttgccattcgtcgcgcaggcggatcatgcgcgagccgaacgcctcgtattccgcccagatcgcaggtatgaccggcccgcattcgccgaccgcgatctcatcggcgaacaaaggcgcaccggcgtcgcgcaatgccccgacctgacaccagtagacgagcaggttcagcttcagattcgtgaggaaccacgcgtcgccatagtgcgccacgatgtgccgtgcgacatccgacgccagcattgcccacctccaggttcgctatgttcgacacctccactatagacaaatagcagcttatactcccgcaaccacctattcaccactgaattcgtcgcgactgattcaccttgtggacattcttcatgcacggcaatgaggaaccgtgccaagtccaaaaacattgcagtctatgtcactttttgcacagcacctgcatttgtctcacacagtcgactggtggaattcagctgcggaaaagtcaggaagccttgggatccgtcaccttgcttagatgactttctacggcactgtcaccgggagcctccacctccgggaaatcgaacagttcgacaatggcatcggcgagttcggcggtacgacgcttgatatctgccgccgtccaatcacgcttctcatcgatcggctgtctcggttcagtaagcgaactgttgagttttaagttctcacgcagaccaacgaactgaccgtcgcgccggtagtcccgcttcgacctcacataattcgcctctccctcctgatacggcggatccgcggcgaacggcagctgctttaggttggagttatacggagttagcgtaaggttaccgagcatatgcacaacctgttcctgtatttctccggcgttcgacgggtcatccggcgaaatcgcctccttccaccactccggcagattggcaccctcaggcaagatgtgctcgatcgtccagcgcggcgtcttattgtcgtactcatcgaggttatcaggtgtcgccttgttgaataggtcactgccaggcagtcggcgttcaagctcgatgagtagaaagcgcgtggtgttcttgttcttgtcatacatgccggactcgagcagtgcactgcgaacggcatcgtcattgatctgcgggagcgcgcccaatttgccgacaatgcaccgcactacatcatcgcccttaagctttttcgactggatctcacgaatgtaatcgagcatcatcgcacgaatattcgacgatttcggtaccagcgtgatatttcggcgcacgtagaacgcgaccatcgcatccaacaatgtgctcaaccgtttagcgtccagatccagccagctacggttctccagcagaaagaacagcaacgggtagagctgggttgactcaagcttgccaagtttgctgagacgttctgtgatctcccgatgctccgatgcagctctctccggcataacgatctgcgcgaatgtctgcgcgcgacggaccatcgtgcgcagatagtcctccccttttttatatttaccatcaatgagtctctggtaatatcgcagcgctttgcctttggtaacggaagagcggctgtcgttctcgaacgcatcgtagttgttaagaaggaactgggtgacagcagcatcgttggtattgccttgctgatcgctgaactcactcattaaacggtcccatgacctgagcacttcgtcgctgtcttgatggagatactcgttgcccgccctgatgaactcaactttgaggagatcaaggagcgtcagcggcttgcctttcgagttgaacgacgagaatacagtgagtgcatcctcaaggccagtgactttgactcgcaatgtgatgattgaattgagcttattgtagaaactctgcaattcttcaggcgtgcgaaactcatcagcgaacagcttttgcgaaatatatttgtaccgtttcggcaaagtgcgatgccagatcttgaccggccgctcaccgaacaccaccccaaggagcgcctgatatccattgctatccggttccaacaattgaaggcgtggcattctggatttctcttcgaggagcagctggcgcttgatatcgcgacgaaggccaatgagttcctcctgttcctcactgatatatttgccagagtctttctgcggttcatccatgaatttcgtcgcatgctcccatactgccaagaggaacaatgacagcgtgatgagtcgctgctgaccatcgatgacatctacagttgattcggaatcccggtggtttgtgacgaggagattgccgacataatatccaggatcctcctgctgaatatcgttgaacagttgttcgatctgttcctccccccacgaataatatcgctgatattcaggaatgatgtaggcgttattgcctcgcatcggcatcaattcttccaacgacttcgtctcagccatgatctgcataatgcacaccttccgcatccgctgttgacctgactgcattgtaaatgatctggatcttcagatcaattcatctggcccattgtgacctgcggcaaaataaatcaagaaattatcaaaaccggtatcataaaaacttggagaactcaggtgacttagagatacgatcactcttgccatgccagagcatctctagccgcgatgcatcatgtggcatctcatccgcttcgttcttacctctaagtaattaccaatatccaaacaatgattcgctcgcaccgcatggaatgtataacgcattatcgtcattcgcgatggcagcgtcgactatttagtccgttttaccgaaattcggcgctcagcttcctatattcttttccctcttacacaagtagaggaggccaaattcaggatctcgcaaaatgcaatacttactacggtagaagccggaacctacatacggtaggagtcagaatgactgacgacgctgttacacgcggcgccggcacaatcgctaaagccgtcatggaagaacatcagcagtggctgctcgttcccacgtagtattgcctcatccaaacatgtgcggtattccgcgatattgccttcaagccatatcgacatggtgagtatcggctcgtgaagcacgcctctggcaatgagttgcagtaagagaagcaaccgactcatcctgccagtgccctgtgcgaatgggcgtagcgctagaaaacggtaatgaaaccgaatgatgtcatcaatcaccgagtcggagatatcattgttatcccaccacgcgaacaggtcatccatcgttcccgatgccatatttctaggtgcaaccagcaccggttcggcagccgtcaatccgtcgcaaagctgccgatgcaattcacgaacgaatttccaatccaatggctgcccaccgcgaaccatcacggtaccgtatcccaacgtatacaaatagttcaatatcgcacgttcagaacccacggttctacgacgctcgatgatgtagcgctctggataggaaagaacatcttcaagtgaagcatcgtacccatcgagactgcaggagattttggattcaagacgagagaaggctcgaacaataggatatcgattcccaagtcgtcgcattagcgcgtcgagacgccgcaattctttccacgcttcaatctgcttttccatagttgcaagataagcccagtcatcaatacaactgcatagatcacgcatctggcgtgatctaaaacccctcacacatggcagtattcaccagattccaggaagaccgatttcattcgcacgctccaggcttgcatgacgggaatcgcgagcgccctcttcctcgccgtgcgcttgttgccgttcgagaagatatggtctcatatccctccgataggtgcgcattccgctgaccgagcgcatatcgcgctacgcatcccctgtcagatgctgatacagttccgtgctcaaaggcttggtcagccgcagatccatctccacaagaccaatactctcgccgtcattgtcacgcttcgtctcgtgcagattcgaatatgaccccacacgacccacgtaatagtacatcttcagcttctcggcgtccgccttacgcatgacgaacagcgggatgaaatgattctcactccattcctcgttgccctttccttcttccatccatttgatttcgcgggatgcggtgctacgcctgtctttgctataccagtgcatttcctgtggattgaggaaacggtcggcgtactggctgttcgcatatttgatgaacactggcatgcttttttcgtctttggggagcagatagccaccgacgctgctgccgttgatctgcttgctccacccgagcagacgttccacttcgaacatcttgtaccgatgctcgtagacgaatccgcggtcgtcttgcaacgaatggccggttttcgccgcttcctcgagaaggtcttcgaatcgtttcaggccagtgcgcacattgtccacgaagaagcggtggaacgtggcgttgttcttgagcatcgcgatgaactccggcgcaaggcaaatcccgtctccgatgcgttcgatgagcgcgcgttccccatacgatttcttggtggatgcgtcgaagaacgaccagtcgagcacgctgagcgccgattcgaactgtgcagcggtgtggtacgacgcggggaatcgtcgcgcaactgtttccctcaactgttccgtcgggatcagcgagacagagccaccagcgcatgacttgatcaattcgtcaaggatgacaagctcttgcggacggattgcaaccaacagcacttcggtggccattttgagccactgttctccttgcgtatcgatcggcacaagcgcatccgcgaatccttcatcatgacctttgcgcgatagcatggcttccgtgtcacgcgcgaagtcataataactgttggctttctgcgccattgtcatcaccaaggatggatcatggcgatagatatccgtcagcatcggaatccgaccaagctcgttgcgaatcaccgaatacttgtcgcgcaacatcctcatatcggaccacgaagccgtatccaacgatttgagcacctgcttgcgtgatatctcatcgaaactgatcgacgacaggccgatcgattctcgttgcatgttcttgcgcgcgctatcgctatcgccagcattgccgtacaacgcaaccggaatgagatagttgttctcgtagttaccaatgaaatcgatgacggtaacgcaggtcttgtgcgggaacttgcgcaatcctcgtcccaactgctgcgtgaacacgatgctggactcggtgttgcgcaacatcacgatctgattgatggcagggatatcgacaccttcattgaatttatcaacggtaaagatgtaatcaagatcaccggattcaagccgatcaatggctccttccacatctctccctgcggttttgccgctgatggcgacagttctgtaattgcgttccgcctgctggttggtctgctgattgaacagttccgagagtcgttctgcctcctccaccccggagcagaacaccagtcccgtcacaggttggtcgtacgagccgtattgttcgagtttacgaatgatgtactgcacgcgtgaaggctcggtcagttcttcgagtgaatactggatctgctgcttgtcttttttcgaaatcccctcagtcgcatcaactcgggtgccgtctgctcccaggaattcgtgtacgccataataatggaacggacacagcatattctcatcgagggccttctgcaaacggatctcataggcgatgttgtgatcgaacagggtgaagatgtcgaaattatcagttcgttccggcgtcgccgtcatgcccagcatgaaatcggcttcggagaagtagtcaatgaccgagcgatagttgtttgcaccagaatgatgagcctcatcgatgaggatgtaatcaaaatcatcgggctcgtaccactccatcatatggcgacgcaacgtgtcgactgtcgcgaacacatactttgcgtcatgctgcttactgttaccggtgagcagaccgagttcgccctcgtcgcaaccgagcacacgctgatacgattcgcgagccgacttgagaatcgtatcgcgattggccacgtacagcatgcgtttcggttggaattgacgtacatcaaaggcggagaggtaggttttgcccgtgcctgtcgccgaaatgacgacagctttccgttcaccctcctcacgcagtttccgaatgttggcgagcgcgtcacgctgcatcgcattcggttcgatccttgccgtgcgcgtttgtcgtagaatctgcgtgcgtggaggcgtgtagttcctgaattcctcctcgtattgcgccaaccatgcatcggtcaacggcacggactgactgacctggtctgccaactcctccctgacctgttcaatgagttgcgcttcgcccgtcgacgagacacgaagattccattcacgttgattctgcaaagcgaatgacgtgagattcgaactaccaacatacaggttgtagtagctgcgatcaccctcctccatacgtcgtgtgaaaaggtaccctttcggatggaacggctgattggctgaaactccttcagtgctttgttgttcccaaatgagcacttccacgttggcctcacgttggagtttcaggagttccttgaaggccttgggcgtattgaaatagttcttggtggaggtgatgatccgattggttttttcgctgttctctgcatggtccaggaacgattggtacatcgatttcagcgcattctcactgacgaatgccacggagatgtcgaacgtctcgctttcccttagctcctctcgaatcgcatcccccattgtgcttcccggctgatttgaaatgagcttgggcacgaatcgttcctgtgccagatcattctgtcggatcaaaccgctcagcacaccatcgacgatgccgtgatccgcagattccagcggttcggttgcagactggctctgcctgacgaaggtgttgtccgcttgaaactggctgctcatatttatgttccgtcacttatgattcgcttatgatcggggttattcggaaacatcagaatgccatgccggagattcgcgtcacggcatcatgatccactggcgcccagcgcagacggggcatctgcgaaggctccacccattcgatgcactcatgttccgtaagtctgggcattccctcgatgagatggcacaggaaggtggtgagttgcacgttgccgaaatcgtagaggtagtcgctggtgcacaccttcttgtcgatgtcaatctcgcagagcagctcctcctcgatctcccgctggagcgcctgctgaggtgtctcgcccgcttcgatcttgccaccgggaaactcccaatacccggcgagagatttgcctgcgccgcgttgcgcgcacagcaccttgccatctttgatgatggcggctccgaccactttaatcagtttcggctcttccatgcatcccccatagcctgtatattccggaaaactatcgggaccaggatacaacgtggatttgcggagctgcaacagggaaatcaagacgactctgttgccaggcatctgctttaccatgtgagcatggaatctccgaggcaatccccgaaacgaaatacccaactccaatatgcgccaatcgttagaacaggtcgacccacagctcattgcgcacaccctcgatgaaggctcggccaccgaccggatcgatctgctcgacgtgctctacgaactcatggaacgcaaactgtatccgaacaaagagaaactggatgacgacgagcacacgaaggtggcatgggctttggaggatggcgcgtattcagtcacacggatacgccatgattcacttctcttccatgcgctattccgacatttcaacgggaatgagaaggcgttaacagatgcgcttgcgccatcgatcatcgacgaactctcggcagacctgtacgcgctcatgacaccggaaatgctggcacagcgcatcgcgagcctcctcgcgcgcaatgcctaagcacaaatgataccgtcgccgtcttagtcacgcttcgcatttgcgcagttcgatgtattgccgctgttcgtcgggcggttgttcgaaccattgccgatggtgagccactggaacatcgagaacccatgattatcgatgaccatcaccttcgccgcgttgccgccagcctgcgagggctgattcgcgatgttgagcacggtcttacggctgccgagcataagcagcagtagcactcccagtacgccgaaacacacgatgagcagcgtcctatgctgctgtacccacgacctgaccgggcagatgttgcatttgtcatcggcgccctcgcactgtgccattgttcggttttccatgccctgcgtcattgggtctcctcgtacctcattgtccagtggattgcaaaaggctctgcatctcatactgtattatcgagtgtggcagacggatcctccgccgccgcaagtccatcgaacatggcaatgtggccccgatgttcgcccaccgtatcacttcgcgtaatcgtcgaggcttctcacagatcgcagcatatacacaccgactcccacacacagccattcgaccagcaggaaggccgcaatggtggacgggtggtaggaacccgtcaacagccagaacaccaggcaatacaccggcaccactactgccgccgcgaacagcaagtatgacgtcccgcgcatcagcacaacgcatggcactctgcacagccacaatcccgcagcggcgacccgtacctcgacatggcagtggctttgcgcaagcacctcgccattcgcgaactccgtgaagccgctcggcaatccatgcaatccgtagaatccacgacgcgggacaccacatcgaacacagaatagaggaaggaacatcatggcgacatatgaatccggaaccgacctggtcgatgcaatcatgaagaaaggcggcagatgctcgcctaccaacttggctggataggtctgctgctggattgggagcatgccgagcaggaaggccacgtgatgcacatgcccgcccccgagtattcgtggaaccgattaggtgagctgtatgagatgttctacgaaacctagcgcgacaccactcccgaccagatgatcgagaccttcaacgagcagatcagctacctgtgctggatgattacggcgttctcccaagaggaactgttcgagccgggacaccgtcagtgggcttcctccaccccttccgcgtggccggtgtggaagtggatccacgtcaacacggtggcgccattcacgtcgttccgcatgaagatccgccgttggaaacgcgagatggcacgccgggacgtcattgagtaggcgaagggagtacccttgtcaaccatgcgcgaaccagattcacgtgaagtgctgcgaatggcccttggcaccgttgtgttcgccgtaatcacggtagtgctcaccggcttccagaatggctggcattcacttaccaccgtccggggcgtgttggacgtgcttgtcccgactctcctatggttcgttggaatgctgatcttccatctcatccgccacccgcgcatgtagatgagccgcgtgtgcgtcacgtgacgcattgcgaacaatcatttggatgccaggcttcattgccttgccgtgcgccgtcttccccgacggctggttgttgttcgggttgccgcccgaattcgagcggcaacctagttgttgacgcgtgcgtccgcgccgtcgttcatcagtgagagcgtgaccgccgagttcatcgtcgtcaccggcacgccgctcatcgtgttgtcgagtccgagaatcatgttcagaatgctgcgcatcgtatttcctttcatccgtggcggtctcgccgcccttgttgtgatggttccaagatacgaagaaaacccggcgcatcccatcaggccggggaatgaatctccacgccgccaaggctccttctcaaccttgcggatgaggcggtcgtcatcccggcatgcggtctccctctgccaccccaatccaagacttgctattcggatgcccgcgctgggatgccagggcatagagaatcggccatgcggtacgctggcaagcaatacgcaaccagaaaggaacaccatgcccacactgcacaccgaacgtctcgtattgcggccatggcgggaatcggacgcggcgacactgtacgaatacgcgaagaacccaaacatcggccccatcgccggctggccgcctcaccagagcatcgaggaaagccttgacgtgatccgcaatgtgttcgatggcccggaggactatgcaatcgcactcgccgacgatccggacaccgcaatcggagcaatctccctcaagctcgccggcaactccgatttcttcccggcaaacgacacgacgcaggcagaaatgggattctggattggcgaaccgttctggggcaacggttacattcccgaagcggcccgcgaactgttgcgccgcggcttcgaaaatctgggactcagcgcaatctggtgcgcgtattacgagggcaacacgaaatcggcgcgcactcaggagaagatcggtttcgaacccatacgcgtcacacagaacgtgccggtgccgctgcttggcgaaacgcgcaccgaacatgtgaatcgaatgacacgcgagcagtgggagacgctcatcgcttaaccgagtttcgttatggagtgaacaattcttttcgttatggagtgaacaattctgcgctacggagtgaacataaacgaatctggaaatctatgaaacgttggaaaatcgccgttttctgacatacagtcacaagagacgttcactccataacgaaactttgttcacgccatagctaacgtctcttaactaactcagcgagcggagtctgcgcgtcaacaaaatagtggatgccagtgcgcatctccaactcgtgggcaattcgccgaacgagcataagtcggtgagaatggtcgcttaatgaggtcttcgtcacctgtatgaacacccagccggatgcctcgattgcgtttcgccggtcactgtcgtgcagccattgccccgaatggaacatgccgtcgtactcaatcgcgattttggcgtcaggataagccaggtcgaggtaatagacattaccgttgatggcacgaatccggtgattaatcataggcatgggcaaaccgtgctgcacaatgcataacctcaatttagtctcccgactcgagtctgtgcccggtctcatcagcgtgagcgcacgttcgcatttcacgatgccgcgaggagcacggcgccccttcaccgcacgaagcgctatgagatagttcttgaaatccgcctgtgagtattgccgatgcacagtgttgcgccgcagtatggagtcgccaagaacgatgagttcctccagactcaagaaccgagccagcatcgcccatgtgcaaatcggcgatgtgaatatgaggtcatcgccgagacatgcgaaatccatcggagcatcccacacgtacaccgccagcatgtgattggcgtcctgagctcgcacacgtggttccagattcttgtttcgcaccaccagctgcatgcgttgctcgctgaggcgcggatgcgcactcaaatcaatccgcggaatctccacccccgccaaccgcaatgctctggtcatgccaaacacatagaccaaaccgaacctatgttcagcacgaaacctcctgcactcacgcgccgcctcttcgctcgcctcacgcaatcgcgtaagcgaatcactctcttcgaaactcatatttcgaccctatggtcgcgcagattcgggcacaatctcaaccgggcattgtggatatgtggaaatgagttatccacatcgttcacagtaggatttcctgcgctatggagtgagcagatccgcattatggggtgaacaggtgcctggtacgtagtctagaaaacgctggaatttcaaggattaacatgttgagacaatctgcaacgttcactctctaacgcagatttgttcactccctagcgagaatgtcattctggagtgtcgccatgctccacgcgcccactgattacactggaacactatgacgaacgagcgtgaagagaactccgcactcgccacattgcgcaagtacttcggctatgagagcttccgccccggccaggcggagctcatcaacgccattctcgaaggacgcgacgtgctcggcgtgatgcccacgggctccggcaaatcggtctgctaccagattccctcgctgctgctgcatggcatcaccattgtgatctccccgctgatctcgctgatgcgcgaccaggtggacggtgcgaacgagatcggcataccggccgcattcatcaacaccacgcagacccctgacgagcaacagcaggtgttcgacgccgccaatgccggtaaggtgaagctgctgtacgtcgctccagagcggttggagacggctcggttccgcgcattcgccacacatgccgatatcgcgctgttcgccgtcgacgaggcgcattgcgtgtcgcagtggggtcaggatttccgctcgtcgtacctggcgatcggcgagttcatcgactcgctgccagaccgccccacggtggccgcgttcacggcgacggcgaccgaacgcgtgcgccgggacatcgtcaatctgctgggattgcgcaacccgctcgtcatggtgacgggattcgatagaacgaatctgtatttcgacatgctcaagctcaacacgcgcgaaaaggcgaactggatagcgcactacgtggccgagcatgccgacgaatccggcattgtgtattgcgcgacccgcaaggagacggaggcgctcgcgcagacactcaacatcatggtgccgcagttacgcaaggcacagggctcccagatggaagacggacccatcgccgcggcataccacggcggcatgccggcgaatgttcgcgagcgcgcgcaacgtgatttcgtcaccgacacggtgccgctcgtcgttgcgacgaacgcgttcggcatgggcatcgacaaatcgaacgttcgctatgtgatccaccacaacatgcccgagagcatagaggcgtactaccaggaggccgggcgcgcggggcgcgacggcgaaccgagccgatgcacgttgctgtggaacgagtcggacattgtgacacggcgtcgcctgctcgacatggcggatcgcaacgagcggctcacccccgaggagcaggaggtggtgcggcgctcgaaacggcaactgctcgatgccatgatcggctactgcagaaccacggactgcctgcacgactacatgacacggtatttcggggaatcgaacggaaccgaacgctcggcggacggccattgcataggcggatgcgtcaactgcgaaagcaccttcgaaacggtggacgtctccgcagtcgcacgcgcgatcagcatgtgcgtgcacgatctgggccagcactacggcatgggcaaggtcgtgcaggtgctgcgcggctccaaagcgcaggatctcgccaatcgcggattggatgcggcgcccacgtacggccgcctgagcgaagtgaacgaagccaagattcgcgacgtgctcaaccagatggtggccgacggcttcctcgtagtgagtgaagggcggctgccactcgtgcagttcggcccccgagccgccgaaacagtggcacccacgttccgatacgagatcaagaaatcggagcgcaagtcgaagtcacgaagcagcggcggagacgcgaagtccacgaaactgagcgccggcgaacgtgccgccgcaggattgggcgccaacaccggcgtggacgcggaactgttcgagcacttgcgtgccctgcgcatgcagatcgcacgcgagataggcaaaccgccctacattgttttctcggatcgcgcactgcgcgacatggccgaacggcacccacacacgtcgaaggagttcctcgaggtcaacggcgtgggcgccaacaagctcgaacgctacggcaaacggttcatggaggtcattcgaatcttcgacaatgcctcgtgagcgccccgccattcgccatgatggcagaccatgcgtccacattacggaacgccgtgagccgaattatgaagtttgtctacgccatggtgtttcttgaaaatatgacgaatttctcatgttgtcgttgtcgctgaccgaacgccacaggcgcgcggttaccgacgcataacttgagatcgatttcacctgtgcacttcatgcacacattccaacatcgaaaacgcttggcagtactggaaaatctgcgggcgaatccactgcatggtcgatgaacggcaatcgagatcagctgtactgcagtcagtgacgacgcaaacctgcggcgtgtttgaaatctgaaaatatacataaacaatcacgcatatcaggattctaaggactcattatggctattcacaccactgttgcagaactcatcggaaacaccccgctcgtcgaactccacaacgtcaccgatggcgtgcgagcgaagatcgccgtgaaggtggagtacttcaatccgggcggttcgtcgaaagaccgcatcgctgagcgcatcatcggcgccgccgaacgtgagggcaagctcaggccgggcggcgtgatcgtggaaccgacgtcgggcaacaccggcgtgggactcgcgctcgtcgcacagcagcgcgggtatcgcaccgtgttcgtgctgcccgacaaggtgagcgagacgaaacgcgcggtgctgcgcgcatacggtgccgaagtggtggtgacgccgaccgacgtcgagcccgacgacccacgttcgtactacagcgtctccgacaggctcgcccgcgagattcccggcgcgttcaaaccgaaccagtacagcaatctcaacggtccgcgctcgcattacgaaaccaccggacccgagatctgggaggcaagcgagggcggtgtcacccacttcgtggcaggcattggcacgggcggcaccatctcgggaaccggccgttatctcaaggaagtctcgaatggcgcggtcacggtgataggcgccgatcccgagggctccatctactcgagcccagccaatgtgcatgggtacgacatcgagggcgtgggcgaggacttctacccaagcgcctttgaccagacgatccccgatgcggtcgagcaggtcaccgacggcgaggcattcctgatgacgcggcgtctggctgccgaggaagggcttcttgtgggcggttcgagcggtatggcggtggcggcggccgtccggtatgcccgggagcacgaccttgacgagtccgcgaccgtggtcgtgctgctgccggattccggccgcgggtacttggagaagattttcaatgacgattggatgatcgaacacgggtacgccgacatcgtggcacgcaccagccggccatcgctcgtcgacggcgtgctgctcgaggtatgatcgcacacacgaacacagcaagcacaatcaaccaagcacaatcaacacagacatacttttcgagaacaggcatatcatgaccagggcagacaccaactacgctcacgacggcatcgcgacccgcgcaatccatgccgggcaggaaccggacgcgctcaccggcgccgtctccactcccatctacatgacctcgacgttcaagcaggacggcgtgggcggattgcgcggcggctacgactactcacggtcggtgaaccccacgcgcacgtcgttcgacgaacagcttgccgcagtggagggcgcggcgttctcaatgagcttctcgtcgggactggcggcgatcgatgtgctgctgcgtgccacaatgcgcccgggtgactcgattctcattggcaacgacgtgtacggcggtacatatcgcctgctgtccaaagtgttcgtgccatggggcgtggaactcgacgtggtggatgccaccgacgtcgcggcgctgaatgcggccctgggtgccaaatcgtatcggtatgtatgggtggagacgccatcgaacccgctgcttggcatcaccgacatcgcattgacggctcagctcgcccatgaacacggcacgaaagtggtggtggacaacacgttcgcatcaccgattctgcagcatccgctcgcggatggcgccgacgccgtggtgtactccaccaccaaatacatcggaggccactcggacgtggtcggaggggcggtgctcgtcaacgaccccgaggtcgccgacgccgtggccttcctgcagaacgccgccggcgcagtgccgtctccgttcgattcgtggctcgacattcgcggattgaaaacacttggcctgcgcgtgcgcaaacacagtgcgaatgccttggaaatcgcgcaatggctggaacgccgccccgagatcgagcgcgtctggtacccgggcctcgagtcccatccgggtcacgagatcgccgcgcggcaaatgcatggcggtttcggcggcatgatctcagtgcaacttgccggcggccctgaagcggcacagcgtttcgcctcctcgacgcggctgttcacgctcgccgagtcgcttggcggcgtggaatcgctcattgaagtgccggcggcaatgacccatgcctctgtttcaggcacaacactcgaggttcccgccaacctcgtgcgtctgtccatcggcatcgaggatgacggcgatctcattgccgacttggagcaggcactgcagcagctctgaaacagtatgagctcaccattccattgagcagagggcctgtaccccataaccgtcgttgggggtacaggcccccttttcagaagactgactcacagacttgctgccgcaatgagcagacgggtgtactcctgctgcggctgctcgagaatctgcgcagacgggccgctttccacgacgcgcccctcatgcatgacgactatgcggtcggctatgttctgcaccacgccgaggtcgtgggagacaagcaccatggccatgttcgggtcacgttcgcgaatcgccgcgaacgcatcgagaatctgcatgcgggccgccacatcgatggcgctcatcgcctcgtcggccaacatgacctgcggatccttcaccactgcgcgcgcaatggccacacgctgtgcctgacctccgctcatgtccatcgggtaccggcccatgaactccgatggctccaagcccactaattccatggctcgcgacacctggcccccaataccgcgctcgtcgcgttcccccgccaggcgcaacggctccgcaatcgaacgccctgccgtccagcgcgggtcgagtgaggcgaacggattctggtacacaatgcccgaagctgcccgtaagctgcgcagctgggcacgaccgctcgctcccagaatgctgacgccgttgaacagcacatcaccggaatcgggttgttccaagccgaacatgatgcgcgtgagggtcgatttgcctgaaccggaggcgccgatgatccccaggcattcgccgggccatacctcgacattcacgtcgaagagcacctgatggcgcccgcgccctcttccgaagctcttgaccgctgcatttgcctgcagcgcggccggcttctgctgttcctcaatcatgattggcacccccgctaccgtcgacatgcaggctgagtgcgcgcgcggccgtcaccagcattgccgtgtattcgtcggccgggtctgcaagcaatgcatcggtgcgtccggcatcgacaatactcccttcccgcagcacataacagtactgggtggcgctcgccagcacggagaaatcatgcgtgacgaacagcatggacgcaccggcctcatcgaccagtccgacgagcaattcgagaatctgctgctgggtgatcgagtcgagcgcggtggtcggctcgtcggcaatgatcaggcgtggtgacgtgatcagcgccgtcgcgatgctcacacgctgctgttggccgccggaaagctggtgggggaatctgtcgagcacatcggccggcagacccactttcgcggccatgttcgccacacgttcggcgcggtcctgcgcaggcagatcgtagtgcaacttgagcggaagctcgatctgttcgcgcacgcgcaacagcgggttgagcgaagccgccggattctggaacaccatgcccatcgccgcaccgcgcagcctggcgagttgcacgtcgttcatgccaaccgtctgcgtgccgttcacattgatcgacccgctcagctgggtgtcttgcggcagcagtcccatgatcgcccgtgcaatcatcgatttgccggagcctgaggagccgatcagtcccacacgctggccgtcgcgaatctgcaggcagacatcgcgaacgatctgcctgcccgcaatcgacacattcacggattgcagatccacactcatgagaccctcctcaacctcgggttgctcagcgggtcggcggcatcgtgcaacgcgtctccgaacagattgagcgccatgacgaccacggtgacgatcaggccgggccacacaaccgtgagcgggtagatcgtgatgaacttgaccgacgaggcgagtgaatacccccaactgggcacaccggacggcacacccacaccgaggtaggtgagccccgtctccgccaacaccgcggttcctgcggcgagcgaacactgcaccgtgaccaccggccgaatgttcgtcagcacatgcgtgaagaacacccgtgccgcagacgcgccgttcgacagcgccgactccacatacaggcttctggcagaaagcatggcctgcgggcgggcgacgcgggcgagattgagcccatacccgaaaccacaggcgagcacaatgcccagaatcgaagcgccaagcggcacggcgagcatgagcgcgatgagcacggtgggaatcgagatgagcgcgtcaatcgccaccacggttccgttcgccagcaatgtgctgtgcgagaccatcagcgacacgagcagcagaccgaaggcgagggcgaaacagacggtgagcaccacgatggccagattcgtgcgcgagccggccatgagccagctgagcacatcggcaccggtgccatcggtgccgagccagtgctcgcgtgacggtttcgcccatacgttgtagccatcggtttgccacaaagaccgcggggtccagaacagcgagacgagcgagaccagcacccacaggccgagcacgatcaacgagaacctgccggtgccgcgcgaccacatcgtcgagacgacgatgcccacgcggcgaaagtgcgtgcgtacagattgcctattcattgctcccctcccccaatcgcgggtcgagtgcccggtgtgtcaggtcgacgagcagtccgattaccaggaagaacgcggccaacatgaacagctcgctctgcacggcaatgaggtcgcgatggccaagatcactcaccaagccggtgcctatgcccggcaatgcgaacaggttctcgatcaccatgactccggtgaccatctcggcgaaagtgaggccgatcactgagacgagctgcggcatcgccagtcgcatgcccacatgccacaacgcctgtctgcgcgtcatgccgcatgccatcgccatctcgacatagccggaggaggcgatggtctgcaacgaggaacgcgtataacgcatgatcgtggcgccgacgatcatgcccacggtgagtgccggcaacaccagactgagcaatgcgcgggacggatcggtccacccacgactcgggaatccctgcgccgggaacacttcgaacacgcccagtccgcgcgcgaacagcagaatgagcagcagaccgccccatagggccggaatggcgcctccaatgatcgcgatggtctggaacagtgccttggccgcacggttcgtcgtgcgcacggcgaggtagccgagcgggattccgaacagcagcgccaccagcatgcccaacacaatgagcgggaacgtgatggcggcacgcgaggcgaccacggaagccacgggctggccggtgagcatggtcatgccgaagtcgccgtgcaacagtccgccgacccactcgaagtattgctgtggaagcggcttgtcgagccccatctgggccctcaactgggccacgcgctcgggcggcgagttcgtgcccgccatcacggcggcgatgtctcccggcagcacgcgcagcatgaggaacacgatgagcgagatcgccaacagcgccaccaggaacatggcgatgcgtcgcaacacatatttcatgaagacacgcgtcctttgagaccgttatgaggccgtttgctacttagttggcgtgtaggtgagctgcgccaacggcatgaacgtctggttcatgttgagtgggaagccctccacgcccttgcccatcgccgtggcgacgcggtagttgaacagccagtcagccgcggcatcctcactcacggtctgcgcggcctcggcgagtttggcatcacgctcgtcgtcgtttgtggcgcccatcgcctcctcgtacaactgctgcaccttccggttgtcgtagccgtaatagtagtccggccgcgtccactgcgagaaatcgtggctctcgttgtggtccaccatcgacaggtcgtagtccttgtcggtgtagacgtcctgcagccacgtggagaattcgaccacgttcaccttgagctcgatgtatgcctccttcaactgcgagcgcagctgttcgccgagctcggtgccgtaggtgttcgggtaggtcaacgtgagtttgagcgggtggtcggcggaatagccggcctgcttcatgagttcgcgtgctttctcgatgtcgtgcgggtacttcgagctcagatcccggtagcccgggtcgagcgaggggatcgggccgccgagcttggcatccacgcccccgcgcgaggcgatgagctggtcatggtctatggcgtaccgaatggcctcgcgcactttcttgtcggcagtcgctttgcctttggcgttgttcatggcaagcacgtatttgtcggtgccgtcgcccactttcaccacgaatcgcgaggtggggtcgcccgactccttggagtgctcggtgccgttggaatccgacgacttggtttcgatccgggcgtcgagcgcggattcggcaagcgcgtaagtgattggcgcaagcacctgcacatcgccggatttgagcgcgttcacggctgcattgtcgtcggcgaagtaacggatcacaatgttcttcgtcttcggtttgttcgatccccagtagttctcgtcggccacgagctcgatcgagttgttcggcgtgaacttggccaccttgtatgggccggaacccactgcctgcgtcttcgccacatacttggcgtccttgtcgaacacaagacccgcacgtccgctcaatgcccacaggagctgcgagtatggcttggtcagtgtgatcaccacggtgtctgcgttcggggcgctgatcgacttgaagttgcgcagcgcgtccgcgtcatggtactgcttctcctccagctgctggatcgaccacaccacatcgtccgcatcgagctcatcgccattcgagaagtgcatgcccttattgaggtggaacgtgtaggtgagaccgtcatcactcacctcccagcttttggcaagggctgggaccaccttgttctcctcgttgcggctcaccagtccttcgtacacgttgccgatgagcacctgatcgagtgacgagcccgcggtgtttcgaatgtccagattcgtcggcgccagcttgagcccgatcgtgaccgtctgtgccggcgttcccgtctggattgcagattccttgcctgcacgcgtatggttcaccacggcgaacacgattgccgccacgatgattacggctatggcgccaagcacccagcctttccaacccgaatgcgtgttcccgcttttctcgtgcgcctgcaatgacgcatcggtgctggctgcgcttgcgttgccagccttgttctcgctcgcagacgcattgtcggcgttctgcggcttcggctcattgttgttctgcaagccgttcttcggttctgtcatggtacctctaatgttcatatgcggcatagggcgcactgggcccgtatgctgcatggttttgtcggttgaccgcctcggcgggtcggtcaccgcgatcattgtatcgcatccggccgcccggacgtcgggtcgtctgctaagttggaggcatcgagcacaaggagcaggcatgattctggcagtcgacatcggcaacacgaacattgtgatcggtctcatggagggcaccgagaccgttgacacctaccgcatcaccacacggtcgaaccacacgtccgacgaatacggcctcatgatcctccaattcctgcaactgagcaattcctcgcccgacgacgtgcaggacgcgatcatctcctccgttgtgccgaaagtgatgcattcgttcatctcctcgatgatcaaattcctgggcatcgacccaatgatcatcggtccgggcatcaaaaccggcatgaacattcgcatggacgacccacgctccctcggcgccgacctgctcgccgactgtgcaggtgcctacaccacctatggcggcccggtgctggtcatagacatgggcactgccaccacctacaactacgtcgacgagaagggcgccattctcgcaggactcatcaccaccggcatcggcaccgcggctgcagcgctcgcctcgaacaccgcccagctgcccgaagtgcagatcacacgacccaaatcgattctcgccgccaacacgaaagacgccatgcaggccggactctactacgactgcctaggtggcatcgaacgcacgatcacacagttccgcgaggagctcgacaccgatttcaaggtggtcgccaccggtggcatgtcgcgcatcttcgactgcccgctcatcgacatcgtcgacccgacgctcatcttcaaaggcatggcctcgatctacgcgaagaatgtgtgacctccgtcaccgctcgatgagcgtgattgcaccatccacaacatgcagggtgacggtggtgccgggtttgaggccaagacggcgaacatccactttcttcatcgtcatgtgctcagccttcgtatcgtccttgctgcctttcttcgagccggcgtagagcacgtcgacaatcgccgtgtcgtctggcatctgcttgatgtcatgcacaatgtctttctgccgtgtcacgccgtcgtctcccacgatgacaggcgtggcgtagggctcgccctgcatctgcggatccagatcgatgtaatgatcctcccctggcccgttcttcgattgcccgagcacaatggaggtgccgatcagcgcggcgatcacggttacgctgagcaaaaccacataccaaatctgcgcgttcatgtctccccgtccttcgaattcgacaacagtatagaatctagatccccagctcaatctttgagctgaattcgagcggatcgccggtgaacgggtcggtgaaggccaacgaacgggcaacgagctggagcggctgggagaagtcgtcgtaggctcgttcctctatgcgcgggtagaaatcatcgccaacaatgggcaaccccagcgaattcatgtgcacgcgaagctggtgggtcttgccggtacggggaagaagccggtatacgccgatcgacatgcccattcgcgcactcatgcgggcatgcaatgcttcgagctcgatcgccgtctccgcattcacctgccccggtatttcctgcgcgcacagcacgcccctcgtctttcggatacgcgagcggcgcaccaatggccagattcgcggaggtgacccgtgcacgacggtgccggtgcggggcgtggcaagcggacgaatcggtgccagacattcatagcacttcctggtgcgatgctcctgaaacagcatctgataggcgccacgggcagcggggtcccgcacgaataccacaatgccggcggtgggacggtcgagtctgtgtgcggggatgatattcggctcccgataccgttcgcgcaagcgcatcaatgccgtttcgcgataccacatgccgcgaggcgtggttgccagaaaatgcggcttgtccacgacaatgatgcgctcgttctcatagaccaccgtgagatcgaacgggatgtgcggttcctcgatcacccagcgatgagcgccgttcactcgacggtgacggatttggcgaggttgcgtggcttgtcgacgtcgtagcccttctgcctggccatgtccatggcgaacagctgcagggggacgatgtcgacgagcgggctcatgagcgtggggcattcgggacgccagaagatcatgtcggcgtagcgttccacgtccttgtcgttctcctcggccacggcgatgatgtacgcaccgcgcgccttgacctcctcgatgcccgagatcaccttcgcatgcagcgtgttgcggccgcgcgcgggaggcacgatgaacaccaccggctcgccctcgtcgaccagcgcgatcgggccgtgcttgagctcgccggcggcgaagccctcggtgaacgtgtacgcgatctccttgagcttcaacgcgccctccaaggccaccgggtagcccacgtgacggccaaggaacaggaaggactgcgcatcctgcagttgctcggcggcacgctgcacgcggtccggctgcgtgtcgagcacccattggatcttggcgggcatggccttgagtgagtcgagggtttggcggatctcgtcgcggaacaccgtgcccttcagttgcgccaggtacaggcccagcacgtaggtcgccgtgatctgcgcgacgaacgccttcgtcgaggcgaccgccacctccgggcccgcatgcgtgtacagcaccgcatccgcctcacgcgggatcgacgcgccctgcgtgttgcagatcgccagcaccttcgacccctgctcacgcgcatgacgcaacgccatcagcgtgtccatcgtctcacccgactgcgagatcgccaccaccagcgtgcgcggcgtcaggatcgggtcacggtagcggaactcatgcgccagctccacctccaccgggatgcgcacccaatgctcgatcgcgtacttggccaccagacccgcatacgacgccgtgccgcagccgatcacgatgatcttgtcgatcatcgtgaaatcatgctcatcgatgcgcacctcgtccaggttgatgctgccggtatcgtccaggcgcccgatcaacgtgcgctgcaccgcggccggctcctcatggatctccttgtccatgaacgaatcccaaccgcccttctccgcggccgacgcatcccaatccacctcgaacacggtgggatcctccaccacgttgccatcgaaatcggtgaccgtcacacccccggcgctgatcatcaccgcctggtcctgatcgatctccatcgccgtcctcgtatacgcgacgaacgccgccacatccgaacccaggtagttctcaccctccccaaggccgacgacgagcggcgaatcatgacgcgcaccgaccacgacacccggctggcggcagtcgatcgccaggatcgtgaacgcaccctcgagcatgcggcccagacggcgcaccgcctcgaacaggtccggcccgcccgtctccgcaatcaccgcgtccacgatcttgcccagcagcttggccgccacctccgtgtcggtgcccgacacgaaccggtacccctcagcctgcagatccaaacgcagctgcgaggcgttctcgatgatcccgttatggatgatcgcgaccctgccatccatgctcgaatgcggatgcgcgttcacatcattgggcacaccgttcgtcgcccaacgtgtatgcccgatcgccaccgtcgcctccggcaacggatccgactcgatatccgccaccagattgctcagacgaccggccttcttcctcacccgcacccgatccatgcccggcgccaccagcgccacacccgccgaatcgtacccacgatactcaagccgctccaagccctgcaaacacacctcaagcggcttatccgaaggacaaagaacactacctgcataacccacaattccacacatgccgaacagcataacagaagatgctgcaaaagcccataccatcagggcaaaacgacaagtcttacgaaaatctgcaaattaggcacatcgaataccgttgaatatctcaatactcatctgaaacacggtatggcatggctcatatggcaatcaacccgcgcaaatcacatgctgctcaagtacactgtaatgagcaggagccgaatacgtgacgcgacgaagcgcccgcttcgccacgaattcgcctgccgcgaagagagttacacgttatgtataccaatatgaaccccgattctgaaccgtggaacattgccctggtggacaacgacgcgctggtgcgcagctacttggaaacctatttgggagggctgcccgagttcaacatctgctggtccatgcaaagcggaagggatgctgtggaggcataccaccacagcatcgcctgcacgaactgtgtgccggatttgattgtcaccgacctgtctatgcacggcatgtcggggttcgaactatgcgccacaatccgattcgagaacgaccatacgcccattctcggatgcagttcctacatgatcgagccgtacgagcgcgacgcggtgaacaatggcatgcagggcctgctgctcaaaaacgaactcgctcaactggccgacggaatgcgtacattgttgagcggccagccgttgctcaagtcgaacggcatgccatacgagaccccgcagcaggcacacgaaagactgctcatgcaaggcaaacctgcaatcatgagcatgtcaccgaacgagcaggccgtgatggagctgtgctcggagggactttccacgcgcaccattgctgaagagaccggcgacagtgaatccacggtgaaaacctacatcagccgcgccatgcgcaaactccgcgcgaaatcacgggctgaggcggtggcgtcatggtcccgcaaaacgaaactgtgaattttcgacacgccgagcagttttgtagtctgtgggactacaatcaatggtttttataatgccgctcttttacaatgaaaactggcgagagagaagggcatctcccccgtaggcgagattctagggcaatgcgggcatccgtgcgaaggggcacggatgcccgcggcactttcctttgatgacatcgtggaaatgggctgactcaacaaactgtgaggaggcaccgcgctgtgctaatccgcaatgctgatggaatgcggtgtgagactgcgcactcgcggctctctcttccctgttacgcagccactcgatatgcggccactcgatatgcagccggagacgcatacagcataagggcacgtacaacactgtgagacgattccagagtgccatttttgcaaactgaaccgcattacggcatcgcgacgctccttagagtgtcgctctcgcactccgagtcccaccgcggcatataagcatataaggaggattacctcttttgcagattccctctcataagggcatagaaagaattccttagcggtctcttttgcaagctgaatcttcccacggcacgtgaatcagtctccagactgccactcctgcacaccgagccgcgctccagcaaacagacaagcctgcaaactgccactcttgcaaaccgaaccccacacgaaccaccatgcgggccctacttttgcgcgagcgagagcgaatctgcaaacatgaccctctggtaactcatcagattgcttcttttgcaatcgcaatctcgtcacagcaaacgaaactctcttgcctgaccacacttgcaactccgctcccagctggaccagcacaacaggatttccacagtcacctttgcaactccgcactcagttgaacatctgcagctagattccgccagtcgcgtttgcaactccactcccggctggacacttgcagcaaaatcccaatagccatccttgcagactcaccctcaactgcgtacacgcaacaagatctcgatagccggctttgcaactccgctaccaactgcgcatgtacagcagaatcacgatagtcacctttgcgaataagcctcaccgcggcatgcgaatcagtgctcatattgctttccttgcatttcatttgctctacctgcaatatgaacaaccgctatctgaccgctattgcaaatcaggtcctactacgacacacgaagaggttcaggaagagtctcctttgcaaaatgaactccgatatagcacgtgaaaacaatctcgatattcatctttgcatctgaaaccactacaagacatcccgcaatccatcgcgacagacttcatcaacgctcgtcttcttgccagcgcttttgcagggcgtgcacgtgactgtccacaattgcgacgaccgccgttgtgaataatgcgtcctccgaccacaatgcccgattccgctgtacaccaccgccccacgctgcttagatggctacatgccacacgaaaggaggcgagatgcgcaggaacagagtggtcgagcaactgcttgactccgcccagcatggacatcgttgcgcatatgcatgcaatcgcaacgagcgagtcgcgctagcccgcagagcgagatccggcgagctcaaccaagtgttcaggaattgttatgtgcggccagattactgggattccctgcgcccggcagagcgaacatggcatatctgccgtacggtgaatcagtacaatcccggcgtggtatttgccggcaagaccgccgccaccctgcttggcttcccattgagccacgcagtgcacgacggcacgatcgtctgtgccgcacgacgaaactggacttccgaacggactcagcatatttacacggatatggactcggcaatcagcatgcagggattgctggtcacgaatccggcacacacattggtagattgcgctttgttgctgcctttcgaagaaacgctgccgatgttcgattccgcgtccaccacgcacttcaaacagatcatggaagtcatgggaaccatgtcgcgtgatgtgagtcccgtcttacgactgttgcatttcgcagatcctcgcagtgagagcggcggcgaatcgaaggcgcgtgccgtgattattgtgctgggttttgtggttccggaattgcagatcagttttttcgaccccgtgacaagaaagacatatcgcacggattacctgtggcgattggccgacggcagagccattgttggcgagttcgatggcatggagaaatacgtgaatccgcagatggtaggatcaaaaaccattgagcagcgcgtgctggcagaacgtgagcgagatgaggcgctccgtcgctgcggcgtttcgcagatcgtgcatttctcatacaacgacgtgatgcaccccgatcagcttcgccgcaaactcgagcaagcaggagtaccctacgtctcctagccgcgcgccgagctatatatgtcttgcgccggccgctgttccatgcgctcatattgtcgcttgtgcaattccgttctcacagagacatgcagattatttcttaacggtcgcctttgcaaactgaatcttcccgcgacatgtgaatcagtccccaggttgccgctcttgcacactgggccgcgctccagcaaacggacgagtctgcagattgccgctttcgcatgccgactcccacacgaaccaccatgcgggatctacttttgcgtgagcgagagcgaatctgcaaacacgaccacctatcagcttccacgatggtctcgcttgcagtgcagattccgcaccggcaaacgaatcgcctctctgatggccacctttgcaactccgcactcaacaaagcgcacatggcaacgcccagataatcatctttgcaagccgaccctcacacggagtgtccgaatacgagcggcgcacggatcacagcacgtgctgcaggaagtcctggaaacgctcctccttgggatgatcgatgatgtccggcgtgccgcgttccaccacgactcccccgtccatgaacacaatctggtcggcgacctccttagcgaagccgatctcatgcgtgaccacgatcatcgtcatgccgtcgttcgcgagcgagcgcatcacattgagcacctcaccgacgagctcggggtcgagtgccgacgtgggctcgtcgaacagcatgatctccggcttcatggcgagcgcgcgcgcaatcgccactcgctgctgctgaccgccggaaagctgggccgggtagtagtcgagacgttcgccgagtccaacgcgctcaagttccttgatggcaagcttgcgtgcctccgccttcggcatgtgcagcacgtgcaccggtgcctccatcacgttttcaagcgcggtcatatgcgggaacagattgaacttctggaacaccatgcccagcttggcgcgctggcgggcgatctccttgtcgttcagcgtctgcaattcaccgttcggcagtttcttgtacccgatcatctcgccatcgacgtcgatctcgccgccggtgatcgtctccagctggttgatgagacgcagaaatgtggatttgcccgaaccggacggcccgagaatcacagtgacggtgcccggctcgacggtcagatcgatgcccttgagcacgtgcaaatcgccaaatgccttgtgcacctgcttggcctccacggctggaatcgcggcggcgatgtcggtggccacgctggctttcggggtttgcgttgcagtggattcgtcgctgttcgacttggtttttctcgtcgcttcgctcatgtgtctctccttatgcccacggcaccgctaggcggtataccccatgaattcggcctggttcgtcttattcacgtcgtctttcggctcgccgtccgtctttcccggcagcggcggctgcttgcccttgggccccaccggacgcgcttggaatcccctgccgaagtgtttctcgagcatcgactggatcaccatgagaatggaggtgatgaacaggtaccagatcgaggccacgagcagcaacggaatcggcttgtagatgcggttggcgatcgcgttcgtcgcgtactgcaaatcgagggtgaacggcacggcgagcaccaacgaggtcgtcttgagcatgccgatcgtctcgttgccggtcggcgggatgataatgcgcatggcctgcggcagaatcacgcggcgcatgatcatcgaacgcttcatgccgagcgccttggcggcttcctcctgcccgggatcgacggcgtcgaggcccgcgcgcacgatctcggccaggtatgcggcctcgttcaacgccagaccgatccatgccgcattgaacgcggttatgatcgcctgcgaatcgatgctccagaactccaccgacgtgagcggaatgcccagcgacagacgtgggatgagcacggcgaacagaccccagaacaccaactgcgtgtatacaggggtgccgcggaagaaccaaatgtagaaccagctgacaccgcggagcaccggattcaccgatttgcgcatgacggccagcaccacggcgagcacgatggccacgaccatggagatcaccgtgagcagcaatgtgtagcccacgccttcgagcacacgctcattgaacaggtacttccacaccacgttccattcgaagcgcgggttggtgatgagtcccttgacgatcatggcggcgaagatgaccacgatgatcgcggcgacgatctggcccgggcgcttgaccggcttggctttgatgcgattggggatcggcagcccttcgctgtcgtgttcaacgtgatgtggcatcgcccttccttcttctctgcgttccgtggcattcggccgtgcgcgcccggcttgcgccgttgcggttccagacatctacctacgatatgtgagtattgtaacgtaccccgttacgcaacggcgccgaccgaccgcatatggctcacgtctgattcgcacgttccatatgcggccggccggcacgcgttcggattcttcagctcaaatccttcggattgatctcggccttgtcgagcgcaccggactccacgccccacgccttgaggatcttcatgtaggtgccgtcgtccatcagatgttgcatggccgcctgcaccgcttcggcgagctgggtgtcgcccttcttgatggcgatgccctgcttgattgttccttcgacctcaccgagttcctcgagttgtccgtcggtctgcgagatcgcgtaacctgccaccggcgagtccgcatagaacacgtccgccttgccggtcacgacgttggtcgcggcatcggtctgctgcttgctcggcatgacctcgaccgcggccttgccatcggcggcgcactgttccttgatcttgttggcatcctcttcctgcgtggtgcccacctgcactgcgatcttcgtgccgcacaggttcttggcgtccaccttgtcgggattgcccttcttcaccacccacatcgagcctgccttgtagtagctcacgaaatcgacggaatcctcacgttcctcggtgatcgtcatcgctgtgatgccgaggtcgtacttgctgcccacgctcggcacgatcgaatcgaagctcgacgagatgaagtccgccttcacgcccagggtcttggcaagcgccttggcgaggtccacatcatacccttccggggtcttgccgtcctccgccacgaattccgccggtgcataggtcatctccatgccgacggtgagtttgccggactcggcgattttctgcggcagcatggccgcgatcttgtcgtccttcttcaccgagtcgacaatcgaggtcgcgttctgcgagtcctttgccgcggtctgcgtttcgtcagtcgtaccgcatgccgcggaaccgagtatgactgcggcaccaagtgcgaatgccgcgaccttcttcatcgtggattgtgcgttgccaaacatgtgtcagcgttccttttcctcatgtgcctgccatgtgctccacatggcgaagttctgcatatattcagtattctcaagcaactatggcaaaaatagtcgccgttttcaaacacttacactgtatacatatgcctagatatgcatattatgcgatgcttatgtttgccgacggcgaatatatgtcagattgcgttcagcgtgcggattcgtgcgctcacttggtcgggttgatctcggccttgtcgatcgcgccggagctcacgccccagttctcgaggatcttctggtaggtgccgtcgtccatgagcttctgcacggccttctggacggcctcatccatctgcttgtcgcccttcttgacgatgatgccttcctcggtcacgccttcgtcggcacccagcggtgcgagcgcgccatcggtctgctcgatcgcatagccggcgactggcgaatccgcatagaacacggccgccttgccattaacgacggcggtggtcacatcggtctgcttggcgaaggtctgcagttcgatggccttcttgccatcggccttgcactgctcgttcatcttgttgagctcctcctcctgggtggtgccggtctgcactgcgaccttgacgccacacaggtccttcgtgtcgaccttgtcgggattgcccttctgggtcacccacgtggagccggccttgtagtaagtgacgaagtcgacggcctcctgacgttcgggggtcacggtgaacgacgaaatgccaatgtcgtacttgctgccgatggacgggatgatcatgtcgaattccgacaccgcggtctccggttcgagtcccatcaccttggcgatcgccttcgtgaggtccacatcatagccgacggcggtcttgccgtcctccccaatgaattccgccggcgcatacgtggtgtcggtgcccacggtgagcttgccgtccttcttcacatagtccggcacgagtgcggcgatcgtctcgtcggtctccacagtgctcgggtcgaacgacgcggccgccgagctgctgctggtgccgctggacttgccgctgtcgcttgcatcactggtgccacatgctgacatgcccgcacacaacacgatggcagcaaatgccgccgtggctttccaagtgttcttcatggctctctcctccgtgttcggcttcaaacacgagtcagggtaggaatcacatgttatcagcgcgtttcggcacccgaggaatctcgtaatctggaagtaatctctcgaatgtggcgtcacccacacacagctcacgttgccaatctgcgtaaaaagggacaactatgcgcaaagatcgacccaaattacgcacgaacccatgcgtcatctcttccgtgccgcacacttcccctgcatacacctccgctgcgtacgcctcccccgcacgcatacacttcccctgcatgcgtatgcttccccgcgtaaaaagggacgaatacaggctatatttgtccctttttacgcagattcacggattcaggagtcagccgcgggcatgcatgttcttgtagcgcatcatgcgcaacgcctcgcgcttgtcttgctcttcacgcaacgcctgccgcttgtcgtactccttcttgccacgggcgagcgcaatcttgagcttcgcgcggccgtcttcgttgaaatacagctgcagcggcacaatggtgtagcccttcgcttgaatctgccggcgcagcttgtctatctgcgcgccgtgcagcagcagcttgcgtttgcgcttgggcgcatggttgttccatgtgccgttgaggtattcgggaatgttcgctccttcgagccacacctcaccccgcttgtcaatcgagatgaacgactccgccagcgaggcacgcccctcgcgcagcgacttcacctcggtgcccgtcaacgcaaggcccgcctcataggtgtcttcgatctcgtagtcgtgccgcgcgcgcctgttctgcgcgatcatcttctcgttgctctgctctttcttcgccacagttgctcctattcgattgttctgggaaccagtctacctaccagtcccccgttcttctgcgactgtcccgctttcccatgccgccggcccttatctccccttcaccttcttccactctctgcgtaaaaagagacatctagggactagattcgtctctttttacgcagacgaggattacacagacgaggactcttcagatgaaggcctcactgatgaaggccacccatctgagaaccacacacatgacgactactcatctggggaccacgcagatgagaacgcggatgagaaaatgagagtttgcagccgaggattgcctagcggaaggtgcgcatatgagttcggggcccgatactgtgatatcgggccccgaatggatgcttggttattggcggctgtcagtggacgtaccagaaccgtcccggattatacagcgtacggtatgtgatggtgtacagaccggccacattcgactccgagatgaggatgctgttgccgttgacctgctcgaccaccgcgacatgaccccatgggctcgaggcgccctcctgccccggcaggaacgacagagcggccccgacctgagggctatggtcgacgcgcaacccgtacgacggggccgtactccaccactggccgccgttaccgagatacgatggcgtgccgatgcccatctgcttgcgacgctcataggcccaccacgtgcactggcctgctgcgtatgcattcccgtaatcgccgttcgatgtgccctggccgcccgtagagggacgggtgacgaccggagtcgggggcgtggacggctgtgatggcgtggacggacgctgagtctgcgccggctgggacggcgtttgcgtctgctggggaacggacggctggggtgccgcagcagcaggtgcctcgacggtaccctgtggctcaggttcctgcacctgcgccgcagcggcagcctgttcggcggcccactgctggttcttcgcatcgatctcagactgcagcatcacggtctgcgcggcctgctgggcggcttgcgtggtgaggctgctcttctggttttccaggtcggctcgtgtgctctcaccggctgcacgcagtttgtcgaggctggatttctcctgctgggcctgcgttgcggcggactgtgcggcggcggacttctgatcggcgtcgttcttgcactgctcgactcgcttctcgattgccttgagcctgtcggcgcggttcatcgaagtgttgaggtcgacggcggcatcggatgccgcattcgcctcgttacgggcgagagcgtcacgcgattgcatcgacttgatgaagtccttcgtgtccttcgagccggtcatgacgctcatgacatcggaggtgtctgagccatgcatcgactcacgagcgctttgtgccacggcggcatgtgcgtcgtcgtagtcctcgccggtctgcttgatcttggcctcgagatcggccttgtctttctcggcggccttgaggcgctccgccgcggcatcggcttcggacttggctgctgcggcatcggagttcgcctgctgcaccttggcctgtgcggcggggatcttgttgttgttgaggtcgtcgagttccacgatcttgtcggccagatcgctgttcactccggcgagctgttcacgtagcgccgcctcgcgctgcttgctctgggcatggctgttctgggcgttcaccaagtcactgtaggtgtctgcgtatgcctgaggcgtgtacgtcgacatcggcaccgccaatgcgcctatgcataggacagaggccagcgaggatgccactacaggtacggtccgtttcctgttcgtcatcgagtccctttctaatacgctgctcaccagcgtatcatcacattcttgaaaatgggcggacgccatgccatattcaactcattcacagaatctgcacaattaacaaagcggcaatgccaatggaatcgcggaaaacacgagccgttacgccttgagatatctacgcagggcgatagacgaggcaagcaccgaaagcaccatggcacccacaatgagaatcggcgagacaagccacaccgtggtctggtccacatatggaatccatgtcaccgacttcgccagccagtcggtcacgaacaccttgacgaacaatgccaatgcaccgcacgaaagcagggagcccgccagcgaggcaatgacgccttcgagaatgaacggcagacggatggtccagttggaggcgccgaccaagcgcatgatctcggtctcctctcttcgcgacgcagccgacatacgaatcgtcgtaccagtgagcatgatcgccgcgatcaccatgatgacggccaaacctccggtggccacggtggcgcggttgagtatggcgaacaccggttcgaagatctgccgctggtcaaccacctcctcaaccccatcacgattcgaaagcacctcggagaccacgcgatagttctcagggttcttgagcttgagccacagcgaatcctgcatgtcggccgcagtgagcgtgcgcccttggtattcgcccttcgggtactgcttgacgaaggagttgttgtagaagtcctcacggctcatgaacgtgacctgcgagacgtcgttcggcaattcctgctggatcaccttctgcagctcgttgatctgcgcggtagtggcagccttgcctgtggagcagttcgcagactgactgttgccgtccgggcacaaccacaccacgacttcgaccttgtcgtaccaatcgcccttggccttcgtgatctgcgcctgagtgagcaacgatgccccgatgaacaggaacgagatgaacgtgacgagcatcaccgaaagcagcatgggcacattgcgtctaaggctcgtccatgtctccgaaagaatgaaacggaatcgcatgctctactcctcgtccttgttcggctcatccggggttctcggtcgcgaatgccgccccttcggcggactcggtggcataggtggcgtggatggttcgatctccttcgtcacgggggccatcgcctgcgtctgttcgacgggcgtcgtcttcccagcggaggcattgccggtggagtcggcttcgccccgcggctcctcgagggtcacggttccccatgccttcccggaatcctgctccatggaggcgtccgcctttgcggcggtcgagacctctcgcgtcttgctggtgtcgatgccctcctgttcggcgagctcctcgagagagaggcctccaccccaggtgagcgtctgttcgacatctgcgaatgcctcgccgtaacggccggtcttgccggcatgcacgctctgggccagacgggctatgccctcgttgctgtgctcggattgcaggatctcattgaccgagtcgaccatggtggtcgcccgttcatcacgctcatgcttgccgctgtgcgacttctgctgattcgttgccggttcgatcaccgcgccggtttcactgccagccacggccccgatgccgacctcggccttgatcgccgcatgcgacatcgcggccacctgctcatccgggaagtacatggcggaatcataagagccgttcttctcgtcacggacaatgctgcccttgttgagctcgaccacgcgtttgcgcatcgagttgacaatctcctcgttgtgtgtggccatcacaatggtagtgccggttcgggagatcgcatcgaggacctccatgatgcccagcgaggtggtcgggtccagattgccggtgggctcgtcggcgagcagcagctgcgggtggttcacataggcgcgcgcaatcgtgacgcgctgctgctcaccgccggagagctcgcgcgggtagttgttctccttgcccgtgagacccaccgtcttaagcaccttgggcaccagcgacttgatcgtggaacgtgaggtgccgatcacctcgagggcgaacgccacgttctcccacacagtcttgttgttgagcagcttgtagtcctggaacaccatgcctatggaacgccggtactgcggcacctgacggttcgggaggcgacgcaggtcgtacccgcccacgcggatctccccgctggtcgcctcctcctcgcgcagcagcaggcgcagcaacgaggtcttgcccgaaccggaggcgcccacgagaaacacgaactcgccacggctgatctcaagatcgatgtcttgcaacgccggtctcttggcattcggatagatcttgctcacatgttccattgagatgagtgccatgggctacttcctccctgcttgcatcgcttgccgccgggccgcgatttactcgttggcttcctcggccgcggcttcgagccgctgctcgtggcgccagcggatgccggcctgaatgaactcgtcaatgtcgccatcgaacaccgcctgagtctgcgaggtctcgcaaccagtgcgcagatccttcaccatttggtacgggtgcagcacgtaggagcgcatctggtctccccagctggccttgatgtcgccggcgagctcctttttcttcttggcctcctcctcatggcggagcacgagcagcctggactggagcacggccatggcggcggcgcggttctgaatctgcgaacgctcgtcctgcatggtcaccacgatgccggtcggaaggtgagtgatgcgcacggcagagtacgtggtgttcacgccctggccgccagggcccgaagcgcagtaggtgtccacgcggatctcactgtcgggcacttcgatgtgatcggtggcctcgacgagcggcaccacttcgacggcggcgaagctggtctggcgacgcccctggttgtcgaacggcgagatgcgcaccagacgatgcgtgccgccttcgaccgacatgcggccataggcgtacggggcgtcgatctggaatgtggcggacttgatgcccgcctcctcggcatacgaggtgtccatcaccttggccttgtatccattgcgctcggcccagcgcaggtacatgcgcagcagcatctgggcgaagtccgcggcatcgacaccgcctgcgccggatcgaatggtcacgacggcggaacgggaatcgtattcgccgtccatcagcgtctcgatctccatctggtcgagatccttctggatgctttcaatctcggtctgtgcctcgtggagcgtgtcggcgtcgttctcctcctggccgagctcgatgagcgtggccacatcgtcgagacggctcgcggcgctcgacagatgcttcagctgggactggcatgcgctcagctggctcatcaccttctgcgcgtgctcggagtcatcccacagtccaggagcggaggcctgctgctcaagctcggcctcttgggacttcagacgatcggtgtccaacgcgagggcgatggactcgtacttggcgcgggcgtcggaaatcgcctgcgaataatcgaattctgccataatctctcacttgctcgtccactgcaaacaccgttgcggtggaatctgttcacattgctcaactgaaatataagataccgtcacaggcaaacgttgccttggcgggaaagcggacgccaccggagtatggctgcgtggcgaacagcgcgagcgtcaaagcccggcgaagatcaatggcatggcaaagccgaccagcattgcgcacacaacaacaatggccacaatgcgcgtggcattgtagctgcgccgggtctggcgtccctcggtgttgtcttgctttttcacggttccctatcttgtttgtcactcacatacaggcgatatgcaagtgtagcaggtggctttctgtttcagccaaccggataccccgccccgttattccactcgcccatctctttgctggcagatgacgaaagctcggcggccatggtcgttgtgttgcatgcgtgtgcagtaaccgaccatggtctgtcgtttgccatagacagcgcagcatagggtgggcagacgtgccgcgaacggacacgaggcgcgccacggcaggtgcgcggtatacagtggcatatgacaatccaatagacaaggagtggcgatgacacagtcgcgcagtgcatggggctggggtctggcgagcattgatgcagccggcaacgtgcttgacgtttggtatccgaaactgacattgggagaggcgccggcagccaagccgaaccatgggttcggcaatctggttcatgagggcgaggacttgcgcggcgtgcgtcgtatgccggtcttcaccgtctcgcgcctcgacgacccggtggtcgacgcgcccgacgcctacttgcgccttcacctgctcagcatgcgcctggccaaaccgaacacgctcaacctcgacggcatcttcggagcgctcaacaacgtcgtgtggacgaactacggcccgttcgccgtcgatgacttcgcacagcgtcgcctggccgtcatgcagggcaatgcgggcgcggggatgccgggcatgcgtgccgaggtcaacgtgctcgccatcgacaagttcccgcgcatgctcgactacgtggtgcccaccggtgtgcgcatcggcgacggcgaccgtgtgcgtctgggcgcctacctgagcgaaggcacgacggtcatgcacgccggcttcgtcaacttcaacgccggcacgctcggcacctgcatgatcgaaggccgcgtctcgcagggcgtcgtggtcggcgacggttccgacgtcggcggtggcgcctcgatcatgggcacgctgtcgggtggcggcaagctgcgcaactcgatcggcgagcattcgctgctcggtgccaatgcgggcatcggcatctcgctcggagataactgcgtcgtggaggccggtctctatgtgaccgccggcacgaagatcgaggtgtgggacaaggagaaggcggcggccggggtcgcactcgatgtggtcaagggcgccgacctgagcgggaagaacaacatcctgttcattcgcaactctctcaccggcgccatccaggcacgtccgcgcaagaccggcatcgcgctcaacgacgcacttcacaagaactgacggcaaaagccccttcccagccgaaacaggtttcgcgaaacggcggaatctcgcggacattgcgaatccatcccggctgaggaggggctttttcatacaaggagtgacatgaacatcgacatcgtctgcgtcggcaaggtcaaggaacgctatctgcgcgacgcaatcgacgaataccgcaaacgcctgtcgcgcttcgcgaaggtcgacgtcattgaggtggccgacgagaagaccccggaacacgcctccgacacgctcaacgcgcagatcaaggagaaggagggcgagcgcatcctcaagcatctgcgcgacggtgccttcgttgttgcgctcgcaatcgaaggcgatcagctgacgagtgagcagctcgcggcacgcatcgcgcagtggggattgcacggcgtcagccacctgcagttcgtgattggcggctcactcggcctcgacccgcgtgtgctgaggcgcgcgaacatgccgctgagcttctcgaagatgacgttcccgcaccagctcatgcgtgtgattctgctcgagcagatctaccgcgcgttcaagatcaacgcgcacgagccctatcacaaatagacacaaatagaacggcgttgactaccgctcgtctatcggcacgtagtcgcgcagcacggcaccggtgtacacctgacgcgggcggccgatcttcgtcatcgggtcggcgagcatctcgcggtactgggcaatccatccggggatgcgtcccagcgcgaacagcggcgtgaacatggaggggccgaagccgattgcacggtagatgagaccggtgtagaaatcgacgttcgggtacaggttgcgcgagacgaaataatcgtcgttgagcgcgatgtcctcaagctgcaacgccacgtcgaagagctgttcgtcgcctggcagcagtttgagcgtcgccttgttctccatgatcttctcgagataatgcttggcgatggccgcgcgcggatcgtacgacttgtacacgcggtggccgagaccggagatgcggctgccttccaccttcgccttctccacgaactgcttgacgctcatgccggagtcgcggattgccatgagctggcgcagcaccgcctcgttcgcgccgccatgccgtgggcccgagagcgcgttgatgccagcggcgacggccgaatacagattcgcgtgcgcggagccggcgatgcgcaccaccgacgtcgagcagttctgctcatggtcggcgtggatgatgagcagacggccgaacgcatgcacatacagcggatcggattcgaagcgttcgtagggcaccgcgaagcacatgcgaatgaagtcgtcgacgtagccgcgcgcatagtccgggtagagcatcggttcgtcgcggcgcctgcgcagaatgtagctgaccaccgtgcgcgccttggccatgatgatcatggcggcctcatcgagctgttccggatcgctgatgtcggtggtgtcggggttgaaggcggcgagcgcgttgattgcggaggccatgacgctcatcggctgcgccccgcgtgggaacgagcccatgaacgtacggaaatcctcacctaccatcgtgtggtggttgatgtcttccacgaatcggttgtactcggcttttgtgggcagctcaccattgcgcagcagccatgagacctccaggaagtccgactgctcacacagctgctcgatcgggtagccccggtatcgcagaatcgaatgctcgccgtctatatacgtgatcctggattcgcattgcgccgtggtgaggaagcccgggtcgagggagacccagttgttgttgcgcagcgacgacatgacgatgccatcggggccggcggtcgccttgaccaccggcagcttgaattcgtcggcctccacatgcagatgcgcttctcccatagctctcctctactcgcccgtcggcattcgccgtattcggtttgccgaacactatagggcacgcacattgcccgcggcgtttccatctcatatcgcaagtttgcacttaatataccatctcatgcaagtatatgcagaattccagtggacgctcatggtactcggggcctgaatatacaaaaagcccgcatgatctgcgggcttgaatctgaggtgtgtggcgatcagttgtagagctttgacagcggatcaccctcgcgtgcagtgagcacaatcggtccgttctcggtgatggcgatcgtgtgctcgctatgggcaccacgcgagccgtccaccgaacgcagcgtccatccgtctcgctggtcctggaagatctcgtcggtggtcttcatgaaccatggctcaatggcgatgacgaggcccggacgcagcttgtagccgtggtgtgccttgccgtcgttgggcacatgcgggtcgccgtgcatgatgtggccgacgccatggccgccgaattcgaggttcaccgggtagccgtattccgccgccacttcgccgatcgcgtgggagatatcacccagacggttgccgggaatggcttcggcgatgcccgcggcgagcgcctcctcggtggacttgatgagacgcaggtcacttggatccttgtctttgccaaccacgaagctgatggccgagtcacccacccagccgtcgacgctgatggcgaggtcgaggctgaccagatcgccgtccttgagcgtgtagtcatacggcacaccgtgcagcaccgcatcgttgatcgaaatgcagatgtaatgggcgaacggtcccgtgccgaagtccggcgcgtagtcgacgtagcaggattgcgcgcccttcctgtcggcaatgcgcttgtgcacaatctcatcgatctccagcagattcgtgcccaccttggtcttctcacgcagctcgttgagaatgctgccgacgaaatggccggccggcttcatttcctcgatctcctggggtgtcttcaattcgatcatcgtgttctcttttccagcaagcttttgccaaaccgttttcagactaatctgcacgccttacattgtaatgggagacgccgcgcatattcgcgcagatatgcgaaacccggcgcatatggcaccgggtttcgcatatattcataaggagtttcagttgttcttcttcacgcggccgaaggtgaaggcacgcacaatcgcgcagatgcccatgaccaccatggcgcagccgccgaagatgatcagccacagcgtggacgccatcggcatgcacagcagcacgaagccggcgatgatcgagatgatcgcgtaggcgatcgcccagcccgagctcggcacgctccacgattcggcaagtgccatcacgccctccatgatccagcagatgcccacgatgagcgtgaacatgatggcgagcatggcggtggacatcgtgacgttcttgaagatgacgatgccgccgatcacgaggatgatgccgatgagcacgccgaggatcctccagccggcgggcagtcccatttcaacgagcgagctgacgatgcgcacgacgcccgaaatgaggaagtagatgccaagcacgatggcggccaccttgagcgtgatgcccggccacacgagcaggcagatgcccaatgcgagcgcggcgacgccgatgacgccgtatgtgccgcgcacgaggttcttcgcgccggtcggcagcattccctcgaacagtcggaatgggctttggttgtattgctggttttgatattgcggattcggttccgacatatctcctccttcagattctctgaacgcaccggcgctccggatgctttccggcatggcgactgcattcgcggatatgtttacttacagtgttatctatccgcggtctgtttgcacagtttcgcccgtgtattctccaacgagcgtagttgacttcggacgagaaatatgtccattcagcttgtacgggtgccagattctacaccgtgacccagcgccgcgctgtcgggaaacatctatagtgtgaagttatggataccactttgcaatcaggcatcgatccggcctcgttctccgccgtgatctcacccaaggacgatctcttccgctatgtgaacggtccgtggatcgacacgtaccgccttcccgatgaccgctccagctacggttccttcaatcgactgtcggaaaacgccgaggagcagattcgcgacattctcgaaacggattccgaggaggcgtcgaaatcgaaggcgctgtaccatgcgttcctcgacaccgacgcgattgaagcagctggaatcgagccgattcgcgccgatctcattgccattgacgaagcacggacgaaagaggggctcatcgatgtgctcgggcggctgagcccgttcggcggtccggacctcttcggcttcagcgtgttcggcgacatgaaccaccctgagacgaatgtgctctacctcggccaggggggcatcggactgcccgacgaagcatactaccgcgaagaccaccatgagcagatccgtcaggagtatgtgtcgatggtcgcgaagcagctgcgcaacgccggctacgccgacgacgaggagaaggcccaggatctcgccgaacggttcctcgacgtcgagactcgcatcgcctcgcaccattgggacaatgtgaagacgagggacccgcaggcgacgaacaaccccaccacttttgacgagctcaaggccatgttcatccatttcgacattgagcgttggatcaaggccgtgcaggaaagctacgacacctcgcatgccgcccgcacgatgccggttgacatgctcggagccttcgcgaacatcattgtggacgagccgagcttcgtcaccggccttgacggattctgggctgcagcgagcctcgacgacctgaagctgtgggcgcgcgtgcatgtgatcatcgacaacgcgagcatgctgagctccgtgttcgacaagacgaacttctcgttctacgggcaggttctttctggcacgaagcagcagcgtgatcggtggaagcgcggcgtctcgctcgtcaatggcatatgcggcgaagatgtcggcaaggtctatgtgaagctgcatttcccggaatcgtcgaagaagcgcatgcaggaactggtgagcaacctcattcaggcctaccacatctcgattgtgaacagcgactggctaggcgaggagaccaagcgcaaggcgattgacaagctcaactccttcgagccgtacatcggctaccccgacgattggcgcgactacacggcgctcgacgtgcatgccgatgccccgctcatggacaacatgagggcggcggccgtctacgagttcggctatcaggtttcgaagagcggcaagcctgtgaacaagggcgaatggctcatgaacccgcagacggtgaacgcgtactacgagcccacccgtaatatcatcgtgttcccagccgccattctgcaacccccgttcttcaatccgcaggccgaggacgccgtgaactacggcggcatcggcaccgtaatcggccatgagatcggccacgggttcgatgaccagggctcccagttcaacggcagcggcaaactcgaggattggtggaccgacgaggaccgcaagcatttcaagcagctcacacaagcgcttatcgaccagtacgacgagttcgtgccggtgcaactgcgtgagaagtacgccgacgagcccgacaagatgccacatgtcaacggctcgcttacgattggcgagaacataggcgatctcagtggcgtcaacatcgcgttgaaggcctatgccttcgcgctggacgagcagcacgggctgcctgtcgacgcctcgccgtccggcatcgaaggagcattggagatgtcccctgagatcgatggattcagcggattgcagcgcttcttcctcgggtacgcacagatctggcgaacgaagatgcgcgatgagctcgcagagcagtacctgcagatcgacccgcactcccccgccgaggaccgtacgaacggcatcgcgcgcaacgtgaatctgttctacaaggccttcggcgtcaccgacaacgaccgcatgtggctcaaaccagaggaacgcgtgcgcatctggtagtctctggcaggcttgccaatgagcatattggccacatatggttgtggggcccgtagggccccacaaccatatgaaaacaagtgcagcgattagaattcgtcttgatcctcaggcctcacctcctttcgcgagttcgtcgtgtcggttgcgcaaccgtgttccaaatcctgcggcggcatcccgttgcctaccaatggctccagggccgcatcccgttgatccccttgctgtggcatgctcgcagcggcatcgggagacaggcaatccggcggcatctggttgaagggatccacgggattgccgccgtcatcgcccggtgccatagaggagcgtgacagggttgattgaggagctgccgacgtagcctgctgggtctgtggacgcatgggggaaccctgctcgtcagatgccatctgtgagggagcctgctgtccggtgtacccttcccgcggcgtgcgcatcgacatcgtgaccacgtagttcaggtccaaaccgacgttgctcgcctcgagcaccagacgtgaatgatccacaccctgctcgtcgcgccattgctcggtgttgagcaatccggtgactatggccgggtcgcctctatgcagcgattgcatgatgttggccgctaggccacgaaaggctttgacggtgagccatgtggtcggcagttgctgccatacgccattacgatcctgataccggcgtgtggatcccagtcggaacgtgcatgcagggcgactcggattcctgccatactgttggggatctgcgccaagataccccgtgatcgtgaccgctccttgttgtaatgccatgtaagcctctttccgtgcgatgtgttcttggttccatcttcaggcaagagacccggcgtgccaagccgaacagggcattgtggtcggaggacggcgtgttggtacaacggtggatgaccgacccattatccacacccgtccacaggcatgtgcataactcgggtggccatggcaggaaatgaatgggccccggtttcccggagcccactgccacatatttcgccttgacctacttcaatgcctcatgcacgcggtcgacgatcacctgcgccactgaatcgacgctgatgttctcactgttggaaccgtcacgatcacgaacctcgatcgtgccgttgttcaccgtatcacggccggcgacggcgatgatcggcacaccgatgagttcggcgtccttgaacttgacgcccggcgagacctttctgcggtcgtcgtagagcacctcgatgccattggccgaaagttcatcgaccagcctctcggcggcttcgaatgccgcttcgtccttgccggtggccatcacatgcacctgggcgggggcgatgttcatcggccacgccagacccttgtcgtcatggtgcgtctcggcgatgcaggcaagcacacggctcacgccaatgccatagcagcccatccacaccggcactgtcttgccattctggttgagcaccttgaggtcgagcgcctcagaatacttgagaccgagctggaacacctgaccaatctccacaccacgctcgaagctgagcgggcctgaaccatccgggctcatgtcgccgtcgcgcacctgaacggcttccaccacgtcgtcggccttgaaatcgcgaccatagacgaggtcgtagtaatccacgccctcctcgtcggcgccggtgaaccatgcagagccttcagccacatgcgcgtcaatcaggtaccgcaacgtctcggccgtcccgtcgtcaccccgcgcctgcgggccgaagcccataggcccgatgtagccgcgtaccagctccggatgcgccttgaggtcgtcctcggtggcctcctcgagctcggccggggcgaactgcgcctccaagcgcttcatgtcgatcgtacgatctcccgggatgcccacaaccaccagttcgcgccatggttcgtcatgctcgtcgtcctcggcatgcttgacggcgatgacgacgttcttgagaatgtctgaggcctgccagtcacggccatcctcgcgcgggtattcggcattcgcgaacgcgatcatctcgtcgatcgtgcgcgcgttcggcgtggcccgcttggtggcatccggggtctgcgaacaatccacggcctcgacagccggcgtgtgcagagcctccacgttccaggccttgccggaaggggccagggcgaacgtatcctcaccaatcggcatcggcgccaggaactcctcggaagcggagccgcccatcgggcccgacatcgcgaacaccggcacatacttcaagtcgagacgctggaagatgcgctcatacgcaccgcgctcatccatgtacgcctggcgcatgccctcctcgtccactgtgaacgagtaggcatccttcataatgaactcgcggccgcgaatcagacccgcgcgggggcggaactcgtcgcggtacttcgtctggatctggtagagcgtcaccggcaggtccttgtacgacgagtacatgtctttgacgagcagcgtgaacatttcctcatgcgtcggtgcaagcaggtaatccgcctcatggcgatccttcaggcggaagatgttgtcgccgtactcctcccaacggtgggtcgcctcgtacggctcgcgcggcagcagggccgggaagtgcacttcctgcgcgccaatgccgttgatctcctcgcgaatgacgtcttcgatcttgttgagaacggcgaggccgagcggcagccacgtccatatgcccggggcggccttgcgaatataaccggctcgctggagcagctttgcggaatcgacgtctgcgtctgcggggtcttcacgcagcgtgcgcaggaacagtgtggacattcgaagagctttggtcatacccttcaaattatgcgtattccacgacatcgccggtgtatgcaagcgggcgccccgccagcgaatgccagcggtgcgcccggatatcggaacggtctgcgagcctattggcgcgcgtcgtcgtcaacgcgttcgtccacgtcgctctcaagcatctcctcgttcaccgagccgaacgggtagacgaagatcatcagcatgaacacgcaaccgaacaggtacagcacgtcgcacaggtcgatcacaccgacggtgagcttgccattcgggaagatcaagccgatcaccatgagcaccatgccgatcaccggcagatactgccacgcccacggattcggcgcgttgtcgcgcattttgcgccgcacggagacaatgtagaacggaatgatgaacatgagtccgccaatgatcgtgagcagatcggagagtttgaaccagcccaccagattcaccggtgcagaggtgtagaacaggaacgccacgaacagcacgagcgcgccgattcctgagatgatgtacattgccgagtgtttcatggatttcctctttcctctgtcagtacgaaatactgttccattctaatcgtgcggctcatcgggcgtgacgaaagcgagccgacggtatctgtgcagcaattcagaacgccggttcgcccgtgccaccgaattcgtcgagcgcgtcgaacaaggtctgcgtggattccgctgcgccggattcacccgtcgcgccgagtacggcatggtccggggaacgatgtgagaacgaatccgccccctgctccgcgagctgcgcggccgcacgggccgatccggcacgcaacgcatcgtcgagcagaacggcgtctgcgctcacattgaacatgcggttatgcacgccgttgaggtacagcccgtcgagcttctccacgcgagagagcgccacataacccatgcccggtgcgaaggtgcgcgacagatccatgatggccgaatcgagcgtcatgccctgcgatttgtgtatcgtaatcgcccaggcgcaccgcagcggcacctgcgacaccgacgcgagcacgtcatcgccatccatcatctcccaatcggcgcgcttcatggtcaccacgttgccgttctcgaattcgacgatgggccaaccgccgcgcgcatccttgaggaatccaatcaccatgcccagcgagccgttcacatagcggccctcggcatcgttgcgcacggccatcaccacggcgttcttcttgagcacgaggtgctcgggagcgagcatgttcctcttgagccgttcgatcagattcgcctgcccgcgcgcctcggcgaagaactcatgctcgtcgccgtcaatctgcgcaagctggcgttcgttcacaagatcggcctgccggttctgcgggaacagggacacggcctgcttcccctcttcaagtggcacctggtagcgggtgatgagaatgtctttgtcgatctgcgagaccatgtcgccacgaatatcggtgagcacacgcagcagctgcccgtcgtcctgacgatgctgctcatcgagatagcagatcaccgggtcgagcgcgtcccaagcaaaggattcagtgacgaatccctccgggttctttcccgcctgcgcataccgctcacgcatcgacacatactcgggcgtgggcgtcatggccgtgttgcgccgcgaggcacccactggcggcaactggaagaaatcgccggagagcaccacctgcaggccgccgaaggggcgcgaatccttgcgtatgatgcggcagacctcgtcgaccatgtcgaacagccacgcgtgcatcatcgagatctcgtcgatcacgagcacgtcagtcgatttgatctgcttgcgccggcgtgtgcggatcgtcttgatgagcgagtcggtgagcgaatcggccacccctatgccgctccatgcgtgaatcgtctggccgtctacatgcgtcgcggcaatgccggtcgtggccgtcaccgcgaccgtggagccctgttcgcgtttggcctgcacaaaccggttgagcacatacgtcttgccggctccgggcgctccggtgaggaacgcgctggcgccggcaagcataatctcaagggcttcgctctgcttcatgctctctacaatagggccgtgacgctacgctgtacagctgtcacctgacgatgcggtcgacgacgcggatcacgccctcctcagtgttcgccggcgcgatgtaggcggcggccgcgcgcacctgcgggtgggcgttggccacggcgaacgaatagcgcgcgtgttcgaacatcggcacgtcgttgagatagtcgccgaacacggcggtctcgtcgacacccacgccaagcgccttctgcaatacgaccacgccgtctcccttggagacgcgcgaatccatgatgtccgcccaatgcttgcccgagagcacgtattcgtaaggctgctcgatgccggcgagcagatccttggccatcggctcggccggttcgaaatcgaagatggcgagcttgaggaatttctcgtcgacgtagtcgagcacttcacgaagattgttcaccggctcgaccttcgcgtagtatttgctcacctcggcgatgaactcctcgtcggtgcgctgaatatacgcggcattgagaccacacaccacgagtccgatgttgtattcgcccgtctcggcggccttgtcgcagatgtcgatgacctgcttgaccagatcacggctcaccgtatgcgtttcgatcacattaccgtccagcgagacgatgttgccgttctcggcgatgaacgacatcggcctgacactgcgcgagaacatctgctgcagcgtctggtactgccgaccgctcgccggcacgaaggtgacgcctttctggttgagcctgtcgagcatcggccagaaccccgcgggaatctgcccgtcggcgtccagcagcgtcgcgtccatgtctgccacgacgagcttgatgtcctgtggttccttgatttccgtccattcaacttctgccatatgcgctcctttgttattgcgcggcgttgccgtatagcggtgcatgaccggctccgcgatactgcagatggttattcggcctcattcatcacgctcgtcgcgacgatctgctcggcgatgcgcttggactgcacggtgtcgggaccgggttcgggcgccatgatggctgcgcggtagtaccgcaactcgtcaagcgactcgacgatgtcggcccatgcgcggtggccgccgttcttcggcggccggttctcgtagaccgccgggtaccagcggcgcgcgagttccttgatcgtgctcacgtcgatcacgcggtaatgcaggtgctccatgagattcggcatgaagcggtcgaggaacttcttgtcggaaccgaccgaattgccggcgagcaatggtttgacgccctgcggaatgaattgttgcacatagtcgatcacctgacgctcggcttcctgcaccgacaagccgttctcccactcgtcgatgaggccggaacgggtgtgcatcgcacgcacgaaatcgtccatatgggcgacagcggcctccgacggcttgatcaccaaatcgattcctttgtcgagcacattgagctcgaaatccgtgggcaccacggagacctcgcacagttcatcgtggaagatgtcgagtccggtcatctcgcagtcgatccagatcatgcgcgatgtctcaggcgaatacgtcagcgcgtcgtttgcgtctaccatgttcctctttcctgccggttccttcatggaccattcgtgctcatattgtagacgcctcacccatatgcggtgtttctcatagcgtagtcgccgcaggtgcccggcatggaaaagcgccgtgacacagattgtatctgcgtcacggcgcttatggctgcatacggctcctaagagccaccgtgttggatatgtgctcagcggccggagtagttcggcgcctcggcggtcatcacgatgtcgtgcggatgcgattcacgcaggccggcgtcggtgatgcgaatgaagcggcccttctcgctcatctcggcgatgttgtgggcaccgatgtagaacatggactggtgcaggccgccgatcatctggtacagcacggcgcccagcggaccgcggtacggcacttcgccttcgacaccctccggcacgatcttgtcggtgctcgtgacgtccgactggaagtaacgatccttggaatacgacttcttacctcgcggtgccatggctcccattgaacccatgccacggtagagcttgtactgcttgccatgcagcagcaccttttcgccaggggcctcctcggtgccggcaagcacgccgccaagcatgacggagctggcgccggcgacgagcgccttggcgatgtcgcccgagtagtggatgccgccgtcggcgatgcacggcacgcctgcggcgcgacatgcctgcgccgcctcatacaccgcggtgagctgcggaacgcccacgcccgccaccacacgcgtcgtgcagattgagccagggcccacacccactttgacggcgtcgacacccgcgtcgatcatcgcctgggcaccctgtcgggtggcgatgttgccgccaatgatgtcaacgccattgaatgcggaatcgttcttgatacgacggatcatgtcgagcgcgatcttcgcctcgccgttggcggtgtcgaccacgagcacatcgacgccggcctccatgagcgcggaggcacgctgccatgcgtcgccgaggtagccgatgccggcggcgacgcgcaggcgtccctggccgtccttcgtggcatccgggtactgttcggtcttcacgaagtccttcaccgtgatcagaccggtcaggtggccttcgccgtcgacgagcggcagcttttcgatcttgttcttcgcgagcaggtcgtgcgcgtccttcttcgagatgtcggacggaccggtgacgaggttctccttcgtcatcacgtccttgacgcgcagatggtcgtagtcctcggaggcgatgaagcgcatgtcgcggttcgtgatgatgccgacgagcttgttgtcgtggtccaccaccggcagaccggagatgtggaacttgccgcacagtttgtcgaggtcggcgagcgtggcgtcgggattcaccgtcaacggatcggtgatcatgccggattcgctgcgcttgaccacatccacctgggcggcctggtcgtcgatggagagattgcggtgcagcacgccgatgccgccgttgcgtgccatcgcgatggccatgtcggcctcggtcaccgtgtccattgcagcggacagcaccggcaccttcatcgtgatgttgcgggtcagatgggtggaggtgtccacttccgacggaatcacgtcggtttcgttcggcaacagcagcacatcgtcataggcgaggcccagctgggcgaagattggggggaggggggtgtatggggattctgcattaggaattgtagccatagcaacactatatggagccacgccgaccaacgccaaaacacacgtccgctctatgaatccgcatgtctttcgcgtcgtcttccgcctgcaaagaggcggaagacgccctccacctgtccccgattacgcagccaatctgccaatctgccaatctgcgtaaaaagagacagaatcgggcatccagatgacccaaattacgcaggggaagcgcaggggaaacagcaagcggggaggcaaagggggggggaagagaaattgcggggatttgcacgaagatcgaagctggcggttatgcccgtccggactcctggacgtgcttgggtgcattgcttttcggcagtacgccgtcattgctgtgagcaccgggacccatgcgcttgaaatacgggtacagcgtggcgatggtgagtagcaccgccagcacgacgaacccgatgagcacatccacgaatctgaagaacagcaggaacatcgaagagaacgcgatcaacgcggcccagccccacagaataagcacggccccctgcacagtatggcctatgcggagcatgcggtgatgcagatgcatgcgatcgggatgcatgggtgactgccccttgcgcaggcgtcgtgtgattgccatgagcatgtcgagcaccggcaggaacagcacgagcacgggcagcagtatcggcatgaatgccggcacgtaggccgaggtgttgatcgtcgccggatcgagacgcccggtgatgatgatcgacgcgcaggtgatgaggtagccgagcagcatcgaaccggagtcccccatgaacagtttcgccgggtgccagttgtgcagcaggaagccaaggcagatgcccaccatcgccacgtcgacgagcgtcgccattgatgcatacgaaacctgctggcgtgacagcacataggagtatatgccgaatgcgatgccgccgatcgccacgatgcctgcggccaagccatcgagtccgtccacgaagttcaccgcattgattgagaccacaatcagcaaggccgtgatcgctatggagatcatcggggacgcggtgagcaggccgccgataggcagcgagatgatctgcagacctccccatgccacgaataccgagatgagcagctggccggcgagtttgagcatccaatcgagatcccacacatcgtcggccacgccgagcaggcagatcatagcggcgcctgccatcaccacccaggcctggtggttctggcggaattcgccttgcaggaagttgagcctggaggcgaagaacatggcggtgatgaaaccgagcagcatggccacgccgcccatgcgtggcgttggcacggtgtgcacgtcacgggcacgcacctcgcccaccgcaccgagctgaatggcgaggtgacggatgagcggcgtgtacaggtacgtggccaccatggccaccatggcaatgaatatgtaggccctcattgaccggccgtacccccatgccgcgcttcctcacgcaccgcccgtctgactgcgtcggcttccaatcgcccctcgcgaaggatcacaatcccatccggagcatcgggatcggcggccaccacggtgcttgccgtatggctcacggtcgggccgccatcgatgtacaggtcaaccgaatcacccaacgccgcaacagcctcatcgacggtctgcgcgctttcgttgccggagcggttcgcactcgacgccgcaaccgggccgattgcacgcagcacacgcaaggtcacctcggaatcggggactcgaatgccttgggtacgcgcgccggaatcgtcgacacgcaccgtgagcagcggcgaatcgtcatcagccacggcaatcggcgagaacgcgccgggcaggaaacggcgagccaatgcatcgagcggcgtgggaagcgcaagaccgagcttgggcagcaccgagaggtccggcataatgacctgcaacgccttgtcagccggccgatgcttggcggcgtagatgcgcgctatggccgcggcgttgcacgggtcgcaggcgatgccgtatacggtgtctgtgggaatgaccaccagaccgccatcggctatgattcgccttgcgtcggccagcgtctgttcgtctgcactgcgcacgtctgccatgtgccttgcctcctgcctatctggcatgttgccagctgtgtccgctccgacctgccgtattgtacgcgccggagctgtgtattcgctgtgatgccgctatgttcatggttctacgggaaaggatgtctcctacttggtcgccaccagatagcgcggccggtaagtgagatcggcccccgtgcgggcgtcactgaatccgctggcgcgcgcgaaggccactgtgcggtcgggctgcgagatgtcgtgctccatgaggaacaggccacccgggcgaagcagcgcataggcacgccgaatgatctgctcgggaatgagcatgccatcagacgatcccccgtacaacgcgagcgacgggtcgaaatcacgcacttccggctgctgcggcacctgcgactgcggcacgtacggcgggttgctcaccacgacgtcgaccgtaccgtcgagatgcgcgagcgtgatcgggcaggtggcatcggcgatctccaagtggtagttcgcggtgatatcggggtatgtgcgtgagatctgcgtgatattgcggcgcgtccacaccgcggcctgcgggctcagttccacgccccacacctgggctcccggaatctcggtggccaatgccagtcccaacgcaccgctgcccgcgcacaagtccacgattcgtggcgaatagattccatgccgtgtcacccactcgatggcgtcctgtgcgatcagttcggtctcctgccgcggaatgaacaccccgggccccaccttgaggtcgagatagcggaacggcgcatggcccacgatgtactgcaacggttcgcgtgcatgacgccggcacaccatgtgcttgaacgtgtgcacgagctccgcgtcgtcgtccctgccgtacttcgcacacagcgcacgcacgtcggtgcgcatgattgcggccgattcgacatcggagggcgagcatccgagcacatccgccatgatcagcttgacgtcatgctcgggggtgtcgactccggcttcgcgcaggtattcggcgcaacggtgaatgagttggtctgtggtcatctgggcttttccgtaatgtgtgaatgcagttgggatacatgccaaagtcggcaggcatgcctattgctgttgctgctgacttgcgagccgctgctcctcgtcagcctggatgtcgctgtcgatcaccgcctgcagatcgccgtcgagcacggcgtccagattgtacgccttgtagttcgtgcggtgatccacaatgcgattctccgggaagttgtaggtgcggattctttccgaacggtcgagcgaacgcacctgcgaatggcgcatgtcggcggcttcggcggcctcctgttcgtgcttcatcgcgagcagacggctcttgagcacgcgcagtgcggcggcgcggttctgaatctgcgatttctcgtcctgcatgctcacaacgatgccggtgggaatgtgcgtcatacgcactgccgaatacgtcgtgttgacggactggccgcccggaccggagctcatgaaaatgtcgatcttcagatctttcgggtcgatctcgatctcatcgtcgtcttcgtcggcctccgggaacacgatgacgcctgcggcggaggtctggatgcgtccctgcgactcggtgaccgggatgcgctgcacgcgatgcacaccgccctcgtatttgagcgatgcccacaccccttcttccggagacgggtttcccttggcgcggatggccatctgcacgtctttcacgccgccgagctcggtggagttctcgctttggatggtcacaccccagccgcgcttctccgcgtaccgcatgtacatgcgcagcagatcgccggcgaacaacgccgcctcctcgccgcccgcgccggctttgatctccatgatcacatcgcgcgcgtcgtccgggtcacgaggaatgagcgccgtacgcagcttctcctccgcctcaggcagctcggactccagacgcttggcttcctgtgcgaaatccggatcctctccggccatctcctgggccgcgtcgaggtcgttcctgatgttgagccatgtgcggtatgcgttgactatggtgccgagctgcgcttgcctgcgaccgagcttgcgcatcttgtcggggttcgaccagacctcctgctcgcccatctggcgttcgatgttctcgtattcctccaacgcggtcttcgccgcgggaaactcttcgcttgccaatcttcgccttacttgactcttgcctacacaaatgcttcgaacagattgaagtgtactcagtcgggtggtccgctcgtgggccgcctatacatagtgggcattgttcacagattccacacacgtggcgtgcggacgaaacggtatgcccggctgcacgggcgcatgccaaacaaaaacgccagcccaacagggctggcgtcgaagcgtatcaggcgctcttcttgccgtagcgcttctcgaagcgggccacacggccgccggtgtcgagaatcttctgcttgccggtgtagaacggatggcacttcgagcacacatccaccgtcatatggtcgcccttggcggtcgaacgcgtctcgaacgtgttaccgcacgaacacgtgacggtcaccttgtgataatcaggatgaataccctgctgcataacatcgtctcctaaagatacgggggacccgggtcgccccaccccgctggcgaagcgtgaaccggacagcaaaagcgtagcccacccgctcgacgtacgacggcgcgcgacgcatcccgcttgggtcactacgccacggaatccgccgtgagatacgccagcggattgtccacgaacttgcgaaggccgatctgcgcggcgccgatgagcgccggcctccgcatgtcccgcgtaagcagaatatgcgcctcgaccttgtcgcgcgcgaggatctggcgctgcacctcggcctgcatgcgttcgcgctcttcggcggagagctgcgcccagcagcctccgatgatcaccgtgtccacgtccgacagattgatggtcgagacgattgccgagaccattgcgccgaaggctttcaaatagacgttgtgcatgggttccgcaccgtcgaaaacagcctgcgtgaacatatctatggcctgttggcttgcggcggcatcgccgctggcaagcccggcgcgctccaccatcgagcggcggcctgcgtagacctcgaggcatccatgccgtccgcaacggcactgcgggccatccagctgcacggaaagatgcccgatctcaccggcgaatccatgtccgccgtccaccaccttgccgtcgcgcacaatggctccgccgatgccgatgtcggtggaaacgtagatgaacgagccgtccggccccaccatgccctcgtcatggacctgcgtggcatagccgggaagatgcgcggttgcagccatgttcgactcatttccggcaaccacattgagtcgcttgatcacgtcgtactgcatgaggtctatgttctcccaaccgaggttgcgcgcgacaatcaggtgcgcatcttcggtgaccaatccgggtagcgcgattccggttccggcaagaatgtagccctgctcgcgcaaggtctgttcctgatcgagcagcatggcgtcgagatcggcgaatatctcgtccgcatccacctcgtgcagatcgcggtccacccaccgctcggccaccgtcgagccgtcaaggtcgagcaccgtatagccgtagccgtcggtgttgatctggatgccgatgccgcacacccggccgccggcgatgatcagcggcgtgctcggcctgccgtataccgcctgcacaagcggcaccccttccctgagcacaccatgctcaatgaggagcgagaccaacagagacatcgtcgccttggtcaatcccgtcgcctttgccagatcggcccggctgagcggttgcggcgagcgcagcacctgattcagaaccaccgagagattgtgattgcgtagatcatcttgattgattcgtttcagcgtcgccatgtcgacccccatcttcgagccaatagttaacccacttgcctaacaagccatgctacactagacttattagtttaatgaacatactatattgggtcgcatacggcagggctgtcgtctgcgatccgcgtaggaaccggaacacacgcgaccacggaacgtctgtggaagccagagcaaggagacaatatggaaccgatgttggttgcgggcgtcgacacttcgacccaatcatgcaaggtgcgcgtcaccgatgcccggacaggtaagctcgtacgcttcggccaggcgaagcacccggacggatcgacagtggatccccaggcctggtgggaggcgttcctcgaagccagtgagcaggccggcggattggacgacgtctcggcaattgccgtcggcggccaacaacatggcatggtgatcctcgacgagcaagggcgcgtgatccgcgatgcgatgctgtggaacgacatctcgtcggcccctcaagccgttgaactcatcgatgaactcggtgcggcaccggcggccgacggcgaaccggaggatcgccacgcccgcggcatctcccgctgggttcgcgcggtgggctcctcccccgtcgcctcatacacgctgacgaagctgcgctgggtgagcgagcacgagccgcaacatgcggcgcgcatagcggccgtctgcctccctcacgactggctgagctggcgcatagccggtttcggaccagtggatcctggcgaggatgcccatttggatgcactgttcaccgaccgttccgacgcctccggcaccttgtatttcgacgcggcgtccaacacctaccggcgcgatctgctcgcccggggcttgcaatcggccgcagcggacgaaccggcacccgaatgcctacaggccgccgcacgcattgtgctgcccgccgtgctgggcccacaagaggccgccaaggtgaaggcctccccatcgattgccggaggcgcggtagacgggggctgcatcatcgccccgggtgggggcgacaatgcaatggcagccctgggcttgggaatggccgtcggagatgtgtcggtgtcccttggcacatcgggtgtcgctgcggctgtgagcgagcgccctgcatacgatctgaacggctctgtttccggattcgcggattgcaccgggcatttcctgcccctggcctgcaccatcaacgcctcccgcattctcgatgcaggacgtgcggtgctcgacgtggactacgaggagctcaccgacctcgccctggccgcgcgccccggtgccggcggcatcacattggtgccgtatttcgacggcgaacgcacaccgaaccgaccggacgccactgccactctcagcgggatgacgctacgcaacaccaatcgcgcgaacttcgcccgcgcattcgtcgaggggttgctgtgctcacaacgagactgtctggagctcatccgctcgctcggcgccgcgattgagcgcatcctactcatcggcggcggagcgaaatcgcgtgcggtgcgcacgttggccccaactgtgctcggcatggagatcacctgccccgccaccgacgaatacgtggccatcggagccgcacgacaggcggcttgggtgctcagcggcgtggatgacgcgcccgattggccgatctcgattgatgcggtgcagaccggcacccccaccccgcaggtctacgacgcctacgtgcaggctcgcggctgattccacccaggccgggtggtgtgcaccatgcgcacattgtgcccaccacccggcattccatattgtcgattccgattccagggagtttcatgagcgtcgtccagaatccaatactcaactcggactttcccgatcccgacatcatcagggtcggccatacctattacatggcgagcaccacgatgcatttcatgcccggatgcgacatattgaggtcgttcgacctgacgcactgggaaccatatggccatgtctaccgcacacttgggcacacgggcgcctatatgctggacgacgatcaggacctgtatgggcagggaatgtgggcgccgtccctgcgatggcacaacggcaggttccatgtgctgttctccgcgaacgacacccatacaacccatctgttcaccgccagggacgcccgcggcccatggcggcatcatatcgtccggggcttctaccacgatccttcgctgctctttgacgatgggcgtgtgttcatcgttcacggcaacaccgcactgcggctgaccgagatggatgcggatctgtccggaccgaaggccggtggactcgaccgtgtgctcgtgcaggatttgccgaatcaggatctgggatacgagggatcccatctgcaacggcatgatgggcggtattacctgttcacctgtcatttcgcccgtggccaccgcaaaaccgaggattgtttcatcgcggattcgcttgacggtgagttccggggccgctgcattctggatgacgacttgggataccatgaccaaggtgtggcgcaaggtggcatggtggacacgcccgatggccaatggtacgcgttcatgttccaggaccgcggggcattgggcaggacacccgtgctcatgccgatgcatttcgatacggacggcatgcccgtattgggcgtgaacgggcgagttccggcatacgtcgaaagcgcgccttccgccgaaccgcaccatcattatgcgccgctcaacggcgatgacgatttccgctacacgcccgatagcaggggaaccatccatctggccccctattggcagttcaaccacacaccacatgacgagacatggtcggtgaccgcgcgccccggcgcattccgcatcaccacaagccgcgtatcggccaccatgctgcgggcgaccaatacgcttacgcaacgcacgaccggcccacggtgcgccgcggaagtgaccattgacgccagcggactcatggaaggcgacatcgccgggctctgcgcattccaaggctgctacgcatacgccgccataacacgcaggcagggatcttggcatgcgatcatggcggaacgcaatgcgttgcacccggacaacaccgccgagcgccattacgacgagatcccggttgaagtggagtccctgccattgccgtcaccgcaggtcacgttccgtttggagatcgactacaccgacatgcgcgataccgcgcgtttccttgtgcggacagacgccgggtggataccgatcggacatccccaccgcctgtggttcaaactggatcatttcacaggatgccggttcgcactgttcacccaagcgacccagcatgttggaggacatgccgacttcatgcgcttccgttatcacgatgcctcggatatgggagcttgacccaaggtgtagtcatgcgccgcgatgcccactgcgcatttccacagggaaacccagatgcaggaagcggtcgccatgcatgtcggtgcggtcccagtgcacaagacccggtccactgggatcgcccatcgccgcaaaacgcgtccaataccgtgacatgcattgggagagctcaacatggcatccacgcatgggtcgccagcatgagcccaaggtcccgaacacgaaccagaggtcggaagaatggaaggagcccgcgtcatcgccgggcatcggcacatcgaaatggtaataatacggtgcgcggccgccaccatgctgccatgctgcgatcagccggcggttgccttcgcggccagcccgcacctgatggccttgcccgtcggacaccatgaattcgtcttgcgtatcacccaccaccagatcgatgttcttggtttggccgtcaagtatcagatcgcgctcctgccgtggcatgaagacgccatcgacacatggcacccaattgaccatcatcggccatgcggcatcatccacaccttcaggcgcctcaagcctagatgctccctcgaacagggtctgcgcatcgacatcccgtgcctcatcgaggttctccacccccagacgccgcatcaaccttgcgcccgtcgactgtgcggattccaatgagcacagcgttgcattgaagtagccaaggcccgcgcctgattgcatgatggcccgggagaacagtccggcattactcggcgcgcagcattgcgccaataccgaagccgcacccgcggattgcccgaagacgcatatgcgcgtggggtcgccaccgaaaacggtgatgttgcggcgcacccaccgaagggcggcctgttggtccaaccatccgaaattcgcatacggggcgccttcctccgctttctcctgcagccagcggtgtgagaaaaatccgaacacgttcagccgatatgccaccgacacaaccacaacgccctgacgcgcgagcgcggtgccgtcgaactccttctccatcgcgcaaccgcactggtaggcgcctccatggatccacaccatgaccggcagggattcgccggtgaggcgcgcatcggcgccgctcccccgcaatgccggcgtccagatgttcagatacaggcaatcctcatcgagcgggatggcgggatccatgccccattccttgtcatagaacgggtttgacgctcccggaatgggttgcaggcaggccggggcatcgtcgaacgcgcaccgtacaccttgccaaggcgccggcgactggggtggtcgccaacgcagcggccccactggtggagcggcgaacggcaccccacgaaaagctgtgatggagggatcacccaccgccaatccctcgagtgttccctgctcacatgtgacttgcctgcgcatcacgcacgtcccgtcccggcatcgacgtctccgccagcgcgcaccgatggctcgatcatggcaccacgcttcaaatcataggcaaatggaggcatcggagtgccacggccatccacaagcagaccgcgtgacgggttgttccgccatgcataccgcagtatgtcgggacgccgctcaggcagcggaatgcacacttctgccccctcaaccgtcgcaggtgcaggcaccgcgcacatggcatcgcgccagacgaactcgaattcgcccggatcgccgccatcgagcgtcaacggcgtgcaagggaccggattggccccttggcgggcaacagtggcataggagacacacagcatcccatcgcgttcctcgatcctctccaccatcggctgcacattgtcgcctccatagagcagcgcacatgccgcgtcgaacagacgtgacgcgacgagcttcttgtcatgcggatgcaagtcgttgggttcaccggcatccagcgtcacgaccgtcttcacgtcgggcacttgctgcccgacggcccactgcccgacgcgtacgagcggccaaccgccgtcctcgatgcaatcgatgctgatgccgggcaattgcacgatgaggaagggcatatgcggatcatgccaacgctcccgccacaaatcgatcatcgtggcgagcagttttccgtattgcgccgccctggtcccggtgttcgattccccttggtaccacagcgcggcgcgtaccgggaaacggaagcaaggcgcgagcatggcgttatacaacccggtggggcgccaacgcacgaaatcctcactcggacatggcctgtccatgctcgccacgacggcaagcctccagaggccgctcacatcatggacctcatcgccgacctgcaaggtcatcgtcttgccttcggtcacccggccggatcccgcgttgcagacaaggcgcacaacaatctcattggcccccgtgtgcagcataccggcaggaatccggtagtcacggggctcatattggttggggcggccccctatgttgattccattgatgtaggtctcatcgatgtcagcccatgcccccaaccgcagcgtgccttcagcaccctcgcaatagggcggcagcaccactgtccgccgcaattcgagcattccctggaatcccggcaacccgcaatcctcaaaacgtgccggcaggtcgacatggcgccaatgcagcttgtcggcaggaattcgccgcgcttgcagttcctccatccacccagcgaccgcagccagactctcttcgctccgcgcctcggccacgccatcacccagatagggatccagctcctccaacgcttcaggacaatcatcgagtgaagcggcgtccatccatgcttcgatgggggaaccgcccaacgatacattgagcagcccgacggggacatgcaaccactggcgcaccattcgcccaaagaaatacgcgactgcggagaattgacccagcgtctcgggtgcacaccccagccatgaggcctcctcatggtcacgcaccgggccggagaaatcgtatcggtccacgaccttgaactggcgcagcaaggggtcatcctgccgctggaactcgctgggatagtacggatgcacccattgcatggaaagctccatattggattgccccgaacacaggaacacctcacccgcatagcatgagcgccgcactgtcgcgccatcgccaatcacttcgaaggcatacgggccgccaggatccaacgcgtccaaccgcacctgccagccgccgtccgcggcgcttatggtttcccctgcacattcgccgatacgtacggagacacgctcccccggtgtgcaccatccccagatgttcacgggtctgccggattgcagcacacatccatcatccagcagctttggcattgtcaatgtcatatgcgtcccttgccttccgtgcggtcatgtcatctgcaccgcagatatggagatgcacgctgggcgggccgtcccggagacggcccgcccagcgtgcatccatggtcattcactcaattcgcggtaatcgaagtccacgaactccgccgttgcgtcatagcccgacaggtccactgccgcgagcccaacgaacgcaccggtgaagaacccgccataccgttggttcacatagtcgtccgacaggatcttcgcgtccagttcgacaccgaggtcatgccactgctcaccatcgaacgaatagtcgtaaccataggtctgcgtgcgcacacgcgtgcgcagccatacggtctccacatcatcgggaaccggcaccgcccggtcccgcaggaacgaggtgtaggtgttgaaatcgttctgggcgacttcgatcacacggcactgccgcttctcatcccaagtgacgaaagcccacgaccagcacaggtcgttgtagtagttcgtcagaccggccatctgccggtagttggtggggtcgaatcgcacaccgacagacgcgtcgaaatcgaacgcctgccaacggcgggcgacgagggacaggtcgaagaggttgcacagcgatccctgcccacgcaaggtcagcgtgccgcctccgacggaacccatcgattcgtcgaagggcacacgcagcgtgttccaatccaaggcgagctgcgacgcctcgaaatcgtcatgctggctgtgatcggccggtgcctcggtctcgatggcgtcttgcggcgcctcgacgacgcgttgtccgccatggccgccgacgacgacaggccagccgtcatcggtccattcgactttctggatggacgtctcacgtcccagggtgcaccatccacgcggatcggtcaccgattcgttctcatggtgccagggccgggcacacagcgacgcgtagtaccattcgccggatggcgtgtccacgagtgcgccatgcccctgcttctgcaggtagctgcgtggggtgtcgaagttgctgatgaacgggtcgtacgggctcccctcgaacgacatcgcatcgagcgtcgaggaacgcgcgacgacctcctgatgcgtccagacggtgccgccctcggcgcagaacaggtagtacatgccgttgattttgtacaggtgcgggccttcgacgagtttgacatcggtgccgcgccaaatcgtgcgttcggtctcggggcgcaggcgcatggtctcgacgtcgaactcggtaagcgtgatgccatcgaagggatggttgtattcacggaaatcccaagtctgctggacgaggtacttgcgcccgtcatcgtcatggaacaggcttgcatcgaagccaacgccgttgatccggatcggttcgctccacgggccacggatatcctcggcggtcacgaggtagttcgtgcagtccttgaacgcgccgttgacgattttgacatcggagtacacgagccagaacttgccgtccgcataggacaggtcgggagcccacacgccgccggaggacgggttgccgcgcatgtcgatctgcgaacgacggttcagcgggctcggcaacaggcgccaatgcaccatgtccttcgactcgtgcagacgcacgccaggccaccattcgaacgtggaattcgcgatgtagtaggtgtctccgaccctgatcatcgacggatcggcgttgaatccgggcagtaccgggttttcgatcttcataacgatctccttaaggaaacggcggcccggttgtgcccgggccgccgcgcttcgtgcattgcaggcgacgggtcggatcagcccttgaccgcgccggtcaggccacccacgatcttcttctggaagatcgtgaagcagatgagggccggaagcatggcgagcgaggtgaacgccaggaccctggccgtatccaccgagtgctgggagctgaacatctgcacaccaagcggaagcgtgtacttgctttcatcgctcaggacgaagagcggaagcatatagccgttccagcttcccacgaaggtgaggatgccggtcgtggcgacgccgggcatcgaaagcgggatgaccatgcgccagaagaagccgaggcgagagcaaccgtccagcaggcacgcctcctccaactccatcggtatggattgcaggaatgggaccaggatgatgatggtctgcggcagaccgaatgcgatctgtggcaggatgatgcccgcgagggagttcgacaggcccaggttcctgatcatcaggtacagcggagtgatgccgacggtcatcgggaacatgaggcccgctgagaacagcgcatacatcagtgccgagtaccggaacctgtagcgggcgatgacgtagctgaccatgatgccgaggacgacgacgccgaccatcgtgcagatgcccacgatcagtgagttgaccagctcggtccagaagatgtcactggtgatgacttccttgtagttgctgatcacccagggattcggcagaccggcagggttgttggtgatctgcgcgttggtgcggaatccgccgaagatgatgtagagcaccgggacgacgcaaatcgccacgagcacgagcgagaagaaatagaccaccggattgccccatggggtcttcgatgacttatggaaaccgttgttcttggaatatgccgttgcagcactcatctcacttcactccttccatggcgaccgccagggcctcatcctctgcggtctgcctcttcttgcgcttcttggacgccttcttctcggtcaaggcgccgtcgagatcacggttgagcacaaagtgctggtaggtcagcgccacgatcagcgaaatgacgaaaatgatgagggcgacggcggagccatatccgtagttgcctgcaccgcgtccctcacggaccatgtaggtggccatcgtggagacgccggccgtcgtggaaacgtactggccccagatgatgtagaccaaatcgaacagctgcagcgaaccgatcatcgacaggaagacccagatgcgcagcgtcggggcgagcaacggcaatgtgatgctcttctggatctgccagaacccggcaccgtccacctttgccgcttcgtacagttcctcaggaatcgactgcatgcccgcaagcatgaggatgacggcgaatccgatgtatttccagctgatgagcagcagcagggtccagatcgcgaccttgggattggctagccaatcgacaccatgcatgccaagtgattcaaggatctggttgactgcgcccttcttctggagcagcaggctccagccggtaccgacgatgacctctgaaacgacatacggcacgaagatgagcgtacggatcaggccacgccccttgaacttctggttgagcaggagagcgaagaggatggccaacgggccctggataacgagggacccaatgacgatttcaaaggtgtgcagaatcgcctgctggaagttcggatccttcaacgccacgatgtagttctgcagtccgacgaacttgccgttctcggccggggtgccgaaacccttccattggtagaaaccgtagtaagctcccagaatgatcggaaggatcacaaagcagcagaagaggatgatcgcgggtgcggaaaggatgaaaatttcgagatttctgcgccccttgccgttagagggtttgcgtgctccgccccgcttcttcgtttcggcaaccggtcgcccgactgccacggcatcattcatttcagtcatgtcatcaatcccatgtatctaaggtgtttcgttgtacgtcatccaggggaaaggatggctggaccatgcgggcacagcccagccatcccggaccttgctcggacgcgatcagcccttctgggcggcgtcctgcatcgccttgacgatgtcttcagggctgccctgccccgacagcatgttcaccacagcggcattcaatgcattgccgatgttggtgcccagtgcggtatccatccacagctgcatggacggagccttgtccagatattcgatgacttgcttgagtgactcgtcggtcaccacggcacgggctggctcggaggctgggatggtggagaacgccttggcgtaatcctcttggttcttcttctcgcccatgtagttgacgaagtcgatcgaggtctgcgaagccttcgggttgacgcagaagtaggtcacgccgcccatgagtgcaccgggctcgccttcgccgccggcgacctcggggaacgcgaagaatccaaggtcagccatcggcttctgatcaggggtgaggtccttgagtacgcccggctcccaagcgcccatgagttccatggccgctttatggttggcgagcaggccggcagaggagttggcgccctgctgcgcggtcgtggtcaggaagccgtcgttgaagaccttcaaatccttgagctcctgcagcttcttgccggcgttgacccagcatgcgttcgagaagtcgtggtcctgaacgctcttgtcgtagacctcaggagagcactcgcgcaggaccagccagtaataccaatgcgccgcaggccaggcatccttggcgccgagcgcaatggcatcggtgccgctgtccttgagtttcttcgcgtccgcgagcagttcctcgtaggtcgccggcacatcggaaacgccagccttcttgaacagatccttggaataccacatgccgcccggttccacgctgaccgggacgccgtagaccttgccgtcgaacgtggccgcggaaagggtcgtcttcatgtcggtcttcaccgtgtccgagatcttatcggtcagatccatgacctgaccggcgtcgatcatctccttggtcttggcgccgccaagcgacatgaatacatccggaccggatgcgggatcctgcatggcggtctgcagtttgccagcgaaatcctcgttctgaatggcctggatctccaccttggtccccgggttggcctcttcgaaggactttgccagattctcccagtattggcggccctcaccggcggaagcattgtgccagaacgtgatggtcttgtcatcggacgacgactccgacccgccacatgcgctcatgccgattacggtcgcaacggccagtgtcgctgctgcaaacgtcttgagtttcatagttcctccttgatctttgtccacgttgacattgacgtggagccgtcctcgctggcacaaatcgccggaaggcaattcatccgagcttctacgaagctctggtgcaacattgagaactatcgaaaacttacgttgttttcgttagaaactaacgtaaacctactttgtcaattagtcaaactaagtgtgttttcggcgtttcgcgcacttttgtatatatttgcttgccgttttcacaacaaacgtcctatttcgtttgcaacattacgaaactttcgctattatgccatatggtatcacacccattcatttgcgacaaaggagctccatatgtcggaacccaaagtcagattggcggacatcgcaaaggacaccggctactcattggcgaccgtctccaaggcgctcaatggccgttccgacatatcggacgaagcccgcgcagccatcgaccgggcgctcaaagccacggggtaccaacgccgcggccagaaaacggccggacaacggtacatcgaagtggtcttccaggacctcgacacaatctgggcgctcgaagtgctgcgcggcgtgttgcgtgagacaaggcactcccccgacatcagcgtcatcacgacggaaagcggcacacgccagcaccccgacgacgactggattaccggcatgttgaggcgcaagccattcggcgtcatcttcatcttcgccaatctcaccgaaagggaaaaaggcagattgcaagacaacggcatcccctacgtcatcttcgacccctcaggcgagccatcgaacgacgacttctccgtgcaggcggacaactgggccggcggcgtgctcgcgacacgtcacttgctcgcgcttgggcacacgcgcatcggcatcatcaccggccccgaagagatgatgtgttcgcgcgcaaggctcgacggttacacgtcggccctcgccgaacagggcatcgagctggaccccgaactggtgaccgaaggtgatttcacgaccgaaggcggctacgcgcaggcgatggcgctgctggagaacccgaaccgccccaccgcgatcttcgccggaagcgacctgcaggcgatgggcgtctatgaggccgcccggcagaaccggctgcgcatccccgaagacctttctgtcgtcgggttcgacgacgtgcagacatccgccttcctgggtccggcgctcaccaccgtgcgccaacccttgcacgacatggcggcggtctcgacgcgcatgctcatcgacacggcggagggacgccccacgcaacaccatgtgatcctgcccaccacacttgtagtgcgcaacagtacgcacgacctgcactgaacgtcccgcaccctatgcttcacaaccgacgaggcaccccacgaagcctccggaccattcagtgctcagcggcgccacgtcgatcacctcgacggccggcgcctcccatgcctgttccgcggactgcgccacgaccacacgcgccatgcctttgtcgaagacgagcatgaccgaccccggctccccttcggagatcggcaccatgccctccctgcgctccggtccctcgccgagcgcccactgcaccgacgccccatcggtcgccacgctcagtgtatggcggctgtcctgccggatgcgcaccgtgccacgcggtgggcacagcacgacgcatctgtcttcaggcatacgccggtacaccacgccatccgcgcgcacggccgcggcttcgccctcgccgacggtaaaaggcatgcgcgcatcgacgacagcctgcgattcgcacggcccgatgcgcatgtcgagcagggtcccgtccgccgcatcgatgcgcaatgtctgcgccagacgccccgctcctccagcgagcaccggccagcccgggtcatcggtccgcctttgcgcgggcccattggattccaatgaccattgcgccggatcgtgctgccactcgacaggtgccacaaaggtctccctgcccaagaaactgagcgccccatggtccgcggtgggggtctcgcgcgaacccaggcacgcgacccaccagccgagccgtggatgatgcagcagatcggcgtggcccacacactgcacgcgctcctccaaacccagatgccggtgcgtcaggaacggattcttcttgcacggatggaacagtcgcgcataccgccccacaaccgaccgttcgtcggcacgcggcgcgcgcggctcggtcccgtccgcatgcgcttggccctgcagggattcgatcgcaggtccgagcccgtcgggtgcccacgtgcgcatggtcatctcgctgtggtcgaagcttgtgccgccttccgcggtcatcagatatacccaatcgccgatgcggtacaggtgcggcccttcggcccacaccgcctccacgccgtatcccgtccagaggaccgttttgccgtagtctccgtctgcgtcatgcgacgcgcacagccgccacgtctccgggtcaatccgctgggtccacacctcggtctgcccttcccagcgcgggcgtacggccggtcttgtctgcgtccagtacacggagccgtcaaggtcctcgaagatgtctggatcgatcccctcggcgccctcgatccagtacgggccgcgccatggtccctcaagcgcatcggcttcgatgatgaagttgccttggcttgtgcgggccgcctcgatcgactccgggtcgaccccagctgcatcggccgcgtccagatcgatgcgggcgaccgtgcatgcgatcacgtacttcccgcggatcatgcgcaatgtcggcgcatacaatcccccggaatcaagcacgaaggggatcagcagccgttgcgccatcgcctcgtcgacggcgttccccgcaagctcccagttcgcgatatcgtccgagacgtggatcggcagtcccggcaccagttcgaacgaggaattcaccagggccactcgctccccgcgctcgtcccacatccagcttgggtcggggtacatgccccgcagtacgggattggtgatgtccatggtcgcggtcgttgcggtcatcgtggtcctccatatcggtagtggtcgatcataccagtacattcggttcggcagtgcgccatgtgcctcgcgtcttgcgcaggcaaaagggcaaacacaccgtcgtgcccgcccgtatggaaaaagcccatgggcctccgggaaccgccgtgctcccccgcgcgcggtgtgtttgatgggaaggatgcgcgcggagcgtatgggtgcacggtgtggctcgatggccctgggcctgcatcgcgcctgcagaggaaaggaaagaacaggcggcgattcattggaaggaaggaaaggaagaatactggcggcatatgccatacggcgtgcactgcatatgccgcgcaccgcagaggttgggtggacggtccggccgtccatgcggcagacggccggaccgtgtgacgtcaggcgttggccagggcgtcgatgatgtagttgttgatggtcgccttcacgtcctcgaggtgatcggggtgcgtggatgcgatgatctcggactgcggcatgtcgatggcgtagtcgttgagcgattcgagggtcgcggtgccgtcgtcgatcgacttaccgatgcccgaatcgtaggagccgtaacgattggccacgaggtcctcgatgtacttgtcctgatgcatcttgtctgccacgagcaggccggcggcgaacgagtccatgccggcgatgtgcgcgcggaacaggtcttcggcgctgaacgaggtgcggcgcggcttggcatcgaagttgaggccgccgtgagggccgatctggccttcatcgagcacttcccacatcacggaggtggtctcgtacaggttggtcgggaactcgtcgagatcccagccaagcagcatgtcgccctggttggcgtcgagcgaaccgagcacgccgttgtcacgcgcgacacggatctcgtgctggtaggtgtggccggcgaggttcgcgtggttgccttcgaggttgagcttgaagacgtcgatcaggtcataggcgcgcaggaagttgcatgccgtggccgcgtcgaagtcgtactggtgcgtcgtcggttccttggccttcggctcgatgaggaactgggcgtccatgccgatctgcttggcgtagtcggcgcacatgtggaagaacttcgccatgtgctcctgctcacgcttcatgtcggtgacccacaggttctcgtagccttcgcggccgccccagaacacgtagttctcggcgcccaggcgcttgccgatctcgagggagtgcttgagctgcgccgcggcataggcgtagacgtcggcgaacggcgaggtggaggcgcccgccacgaagcgcgggttggtgaagagcgacgaggtgttccacagcagcttcacgccggtggactgcatgttctcttcgatcttgtcgaccacgcggtcgaggttggcgttcgtctcgcgcagcgtatcgccttccggggcgatgtcgcggtcatggaagcagaagtactcggcgccgagcttggtgaagaactcgaacgcgtagtccaccttggcgagcgcgttgtccatcgggtcggaatacttgccatcccacgggcgctgggcggtgccgtcaccgaaggggtcggtgagcggcgcgtcgaaggtgtgccaccatgcgacgccgaagcgcagccagtccttcatcttcttgccggcgaccactttgtcggcgtcataatactggaagccgagtccctcctgaagccccttggtgcgaccgacatactcgatcttgtcgatgtcccacagacctgccatgactactcctttgcaatcattttcactgttcgacgcgagtcgcaccgggcatcccacgccatttcagatttgtccagaacgcttccgcgttcatggtgttatagtaaaacgaaaatactatatatgtcaaatggattgacttttagcgtgtcgcccggaattccagcactcctcgctcatgccacacatccatgcagatcgatttcctcgccacaccgaccaacgttccgaaaagtccgcaggcaaacaaaaagcgccagtgttgcctggcgcttctctgtcacagggaccgactagttcttcttgccgtagcgcttctcgaagcgggccacacggccgccggtgtcgagaatcttctgcttgccggtgtagaacggatggcacttcgagcacacatccaccgtcatatggtcgcccttggcggtcgaacgcgtctcgaacgtgttaccgcacgaacacgtgacggtcaccttgtgataatcaggatgaataccctgctgcataacatcgtctcctaaagatacgggggacccgggtccactcacatacgcaaacgcatacgcaagcggtgaaccggctatgtttgcgcgcgccgctatggcgcccgcaagtgggctttcgtccaccaagacccacaatacgagcacgtcacggtttattccgatcggttatccttccggcatactcatctacgcgcaccggcaatccaatagaattaatttaggtaagtgggggtctgaatataaaatattattatcttccctgagtatattgtagaatatttacctacacgtattctgtctgcacgccgagaacaaaacccaaaatgtattatgaacgccgtctgtatcgcctaatgtacctcgtatggccgatagacagattagcgaagtattaggggattttcttcaccgatatcgagaattgtatggcatcgacgccgattcgttcctgagatgcgcgcactcatacggcatgaattggggcgaccgcacgctcaatgtgattgaaaagggccaggcgactgcgggcattcgtctcacgctcgtcatattgtgcgtgctgaaccagatcagcgacgccaaactcaggctcgccgacattctcgatttcaccgacccagccgattccattcgcatcacacccgacatctccaccccttcgcgcacccttcagcgcattctgcgcggacgacccgtatggttctatggctcgccggagcgccccggcaacgtggatcgcgcacaacgtgagcacgaggtacgccgttcgcgcgatgccgacaatctgacgccccctccacctacctgcaccgaggagcaggcaatggcacggcttgacgtggatctgcagaccctacgcggttggtgcaatgcgctgttcggcatgtcgctcgacgaaaccgcacatatgcgagcgcaggcttccgcggactcgacgcccgagctcgaggcgcacgcgatcgtggaggaaatctaccaggaccatgtacgcaaagtgaagtattcgatgcgcaactgcacgacatggagcaattcgagtatcaatctcatgccgaccgacgaactcgaccgcttggaggacgatctttcccaaatggaggattgcctcatgaaattcatggcattgcgccacatctccttcgtgcgcgacaagcgtgcctacgacgccgacccgcggaatacgggcccctatgcgttccaaccagattcggatatctgggttgacatcgatgagccggaggatggcacactaggtgccgaggagtcctgaccaacgccgcgaactccgaaccgagcaacggatgcacgcaaagggccgcctcccgaaggagacggccttgtaccatgtggggcctcaggggcttgaaccctggaccggcggattatgagtccgatgctctaaccgactgagctaaggccccatgtgcggtgcggaaccaccacaagtccaatagtctaccaaagcacccaagaccgccgtggcagaacgacatgcggcacggcccattcagtgcttgtccttgttcttttcctcctccgccttcgccttggcctcggcctccttgcgcttctgctccgcctcctgagccttgcgttcggcctccgcacgcgcctgttcctcctgccgcagattctctcggttcgaacgctccacggcatccattctggcgttgagatcgtccatgagcgtgccgatcctgcccatatcggtttctccgctgcggttccgcgcctcgccaatgagcttggagaggtcgtcccacactgcttcatccgtcacatgaccctgtgcggaggtgagaatgttgtcggcattacggagcacctcctcgagtgaggcatgggcgtcctccgcctgcttggcgtgccttgactcattgactgcctgaatggcgcttctcagcgaagcggtgtgctcgtcgtaccattgggacgatgccttcgcctgcgcaatgcggttctcaaattcctccacactgctcacatcgcagttcaccgtcgccggggattcgctggccatctcaatatcaagctgcttgacgaccgtcatgtctttgacgtcgacatcggcgatcttgctcgccagttcaccgtcgccacccacgaggtcttggtacgccaccaccttgtcgtcgagcccgacgagcgagcgctcgcattccgtacgtttcgcagcgattatggattgacggtggcgtcctatgccgaaaatgaccgcaatgagcacggcgagcaccgcgagtatgctcacacaggtgacggcaagccgcctgtagaatccacgatcatcgtcgtccggctgccgtcggtgcgatgtcggaggtcggcgtcccattgccgcgatttcgttgggattgatgagttcggtttgagaaccggcctcattgcctgcatacatgatcgtcttatcgtccacagttacttcctcatcgccccacgtctcggaccggtactgcttgccagatgcaccgatgccaatcacacggattcgctacgagctgaacagttcacaaggtatccgtccatctcccattgaagaacgttctgcccgcatttcgaacaacatgagcaccgcatcggatatatgtcaagcattctacagaagcttccgccaaaaacaaagcagccgccccatggggcggctgactgtcgcaaagcgtccacaatcggcgaggaggcacggaatgcaatcctcgtttactcttcacgcacgtgcaccgcgcggccggaagcgaagtggtcgagagccccggtcttggccacagcgacgaatagaagccaactgaacacaccggcgatgagcgcaccgcccaccagctcgctgatcatgtgcacaatgccacgcgggctgagcaatgcgacaccctgatagcggaagaacagcaagtagaagccgtattccagcgcggtgcacagaccggagagcacggccatgggcagattgaacacgcggtatcgggtcgcagcgaacgggatctcggcgaaaacgccctgcagaatcgctgagatgaatacgaatccaaatgcgaagttgtttccaagcagcatttcaaccgcactgccgaccacattcacatacaccgcagcacccggtttgcgcaggatgagcacggcgagcgtgccggagaaataccacacggcgtgcagaacactcgcaatgccaggcagaatggagccaagcaccgatgaaatcggggtgtaggcgaagttgaaaccccagaagacgagtccgcagcccacacccagcgcagcgccaagggcaatgtccgccggcgtccagcggaatcgggaagaggatggacggggtgattgggtgatgccggtagacatatggctccttattacatacatggtcgcacacagaatcggaatatggcgcgtcttgacctgcgcgactcggacggatgcgcctcaatcatcttaaattgcatcccatatttcggcaagcgcgatggcaccacgtggaatccacctgcgtggacgagtgtccacatagatgaacgacacggcggcgacacgcgcgaaccggctagattgttgtcaaccccagtgagagggcggccgcctacgtcgaaggcatggcggccaggtggcttcaaggagacaggagagcacgcatgggcgagcacgtggataccatctgcgtacagggcggctaccagccgggcaacggcgaatcacgcacaccgccgatcattcaggcgacgacgttcaaatacacatcgagcgaacagatgagccgcctgttcgatctgtcggagaccggctacttctacacgcgcctgcagaaccccacgaacgacacggttgcggcgaagatctgcgagatggagggcggtgtggcggccatgctcacgtcaagcggacaggcggcgaatttcttcgcattgttcaacatatgcaacgaaggcgatcacatcgtcgcatcgagcgcgatctacggtggcaccttcaacctcatcaacgtgacgatgcgcaagatgggcatcacctgcaccttcgtgaacccggactgttccccggaggagctcgaggcggcattccagccgaacacgaaggcggtgttcggcgagtcgatctcgaacccggcgctcatcgtgcttgacttcgacaagttcgcgaaggccgcgcacagccacggcgtgccgctcatcgtggacaacacgttccccacgccgatcaactgccgtccgttcgaatacggcgtcgacatcgtcacccatgccacgacgaagtacatggacggccacggttcatgcgtgggcggcgcgattgtggactccggcaatttcgactggctcgcccactccgccaaattccccgggctgtgcacgccggacgactcctaccatggcgtcgtgtatgcgaaggacttcggcaaggccgcattcatcacgaaggcgaccgcccagctcatgcgcgacttcggctccacgccggcgccgatcaactcgtggatcatgggcatgcacctcgaatcactgggcgtgcgcatggaacgccattgcgcgaacgcccgcgcggttgcgcaattcctcgaagacgatccgcgcatctcctgggtgagttgcccggagctgcccacagaccgctaccatgccctggccgagaagtacatgccgaacggcacgtgcggcgtcatctcattcggcgtgcccggcggccgtgagaaggtctccgccttcctcgaccatctgaagatgatctccatcgccacgcatgtggccgacgcgcgcagctgcacgctctaccctgccggcaccacgcatcgtcagctcaccgaggagcagctcgaggaggccggcgtgggcgtggatctggtgcggctgagctgcggcatcgagaatccggacgacatcattgccgaccttcgacaagcgctcgacgccgtcttcggcgagtgagcggcgctgcgtaaatgtgcagatctcggattcagatgagcacgccgttgcagtgatcgatctcgtgctggatgatctgcgcggtccagtcggtgaaggtggcgtggcgagcgcgtcccttgcgtgtcgtgtaatcgacctcgatgcggcggaaacgtggtgtgtggcgctcgccatgcagcgagaggcagccttcacaggcgtcgtattcaccgtcggcggcagtgatctgcgggttgaacatgacagtgatcgcgctgcccaggccttcgtcgacgaaggcgatcacgcgcttcggctcgcctatcatgttcgccgccatgcccacgcattcttcgcggtgcgcggcgagcgtctccttcagatcctgcgcaatggcggcgtcgagcgggtcggctgggtcggcggggtcgctgggacgtgagagaaagctggtatcggtgacaatcgttcgctgcattcgcccagtatatctggtgtttgaacgattgtgcgcagattggctgcggttcggaatatcaatgccttgcgcggtgtttgcgctgtagacctcttttggaataatggtcgtgcatttgcgtaagactctgcgatgcacatcgcatgcgttactagaacggaatcaagttggcagaattcatttatcagatgatcaacgcccgcaaggcgtacggagatcgcgtgatcctcgacaacgtcacgctgagtttcctaccgggcgccaagatcggcgtcgtgggcccgaacggcatgggcaaatccacactgctcaagatcatggccggtctcgacacggtgagtaacggcgaggcacagctcacccccggctacacggtgggcatcctgcagcaggaaccccctctggatgaagacaagaccgtgggcgagaacatcaagatggcattcggcgatgtggctgccaaggtcgcgcgcttcaatgagatcggcgaggagatggcgaatccggatgccgacttcgactccctcatggaggagatgggcaagctgcagaccgagatcgacgcggcgaacggctgggatctcgactcgcagctcgaacaggccatggacgcgctgcagtgcccggatccggacaccccggtgtcggtgtgctccggtggcgagcgccgtcgtgtggcgctgtgcaagctgctgcttgaggcccccgacctgctgctgctcgacgagcccaccaaccacttggacgccgaatcgattctgtggctcgaaaagttcctgcaccagtaccccggtgccgtgatcgccgtgacccacgaccgttacttcatggacaatgtggccgaatggatctgcgaggtggaccgcggccagctctacccgtacaagggcaactactccacctatttggagacgaaggccaagcgtatggagatccagggcgccaaggacgccaagctcgccaagcgcctcaagaacgagctcgaatgggtgaggtcctcaccgaaggctcgtcaggccaagaacaaggcccgtcttgagcgctacgaccagatggagcaggaggcacgcaactccaagaagctcgacttctccgagattcagattccgccgggacctcgcctgggctccaccgtgctcgaggccgagcacattcacaaggccttcggcgaccgcgtgctcatcgacgacctgagcttcacgttgccgcgcaatggcatcgtgggtgtgatcggcccgaacggcgtgggcaagtccacgctgttcaagacgatcgtgggcctcgaaccgctgtcgggcggcgatctcaagatcggcgacaccgtcaagatcagctacgtcgaccagaaccgcgccggactcgacccgaacaagaacctgtgggaggcggtctccgacggcaacgatttcatcgaggtcggcggcgtcgaggtgcccacccgcgcctatgtggccagcttcggcttcaagggatccgaccagcagaagctcaccggcgtgctctccggcggcgagcgcaaccgactgaaccttgcgctcacgttgaagcagggcggcaatctgctgctgctcgacgagcctacgaacgacctcgatgtcgagacgttggagtcgctcgagaacgcgctcatcgagttcccgggctgcgccgtggtgatctcccatgaccgctggttcctcgaccgcatcgccacgcacatcctggcgtgggagggcgacgacgagcatccggccaattggtactggttcgagggcaatttccaggcctaccaggagaacaagatcgcccgtctgggcgaggaggccgcacgcccgcaccgcttgcaccgcaagctcacgcgctagcagcggaatctgcacgcgcattgtcgcacacggatgaacggggaggccgtcggccttcccgttcgtccttgcggggcattgcgtctggccgcatacgggtatcacgcttttcgtaacattcttttgcccgttcttaacacgcgccatgtagattactcacattgacatagaacagcagattacccacgtgttgcatgcaacacgtgcatggctgcatggcatgcgagaaggcagaacatggcaagcgataccaagaccccgctccaacgaatcgtcgacgtgctcaaactgggcgagccgtcgcaatatcgtgaccatacctatatcaacggcgagagcatgtacttccccaccggtcgcgtatacggcggccaggtgatctcgcagtcgctcatcgccgcatcgaagacggtgccggaagaccgtctcccccattcgatccacgggtatttcatcgccccgggcgacattcaccaggatctgctgttcgatgtggagaatctgcgcgacgggcactccttctccgcgcgccgtgtgaatgtgacgcagtcgcagggctcgattctgacggccattgcgagtttccagacgaaggaccagccaggtgtcgagtatttcgaccccatgccggccgatgttccggacccagagtcactgcccagctcggtggatctcatgaagccgtatgcggatcagtccgactacgcgaagtactacgccacgacgtcgccattcgacattcgctacatctcctcgccgattgtgctcggccccgatgaggagagccacagactcgacaccggcaagcagatgctgtggatgcgtgccatgggtgagatcgaggtctcgcagaccttccaccgcgcgttgctcgcactcggctgcgatcaagtgatgctcgagcccattctgcgtcgtgccggtctcacactgctcacgccgggcatttccttcgcatcgatagaccattcgatgtggtggtatcgcgacatcgacgtgacgaagtggcatctgtatgtgcaggacacgccgactgccgcccatggccgcgggctgtcttcggcaaaggtgtactcccaggagggcgatctcgtggcgtgcatggtgcaggaggcgatgattcgcgtcccgcagacagactgaccctctgccggattgtgtgcctgtctgtcagtcgagagagcacggacgtctcagtcgatatgccaactaattgcagggcttctcccacttgtcgctctcatcggccccgttattgccggcatgatgccctgcggcctgcatcggcaagccagacgccctgttagtgaacctcgccaaccgctcctcacggcgtttgcgcacgaccttcggatgctccggtcccatgttcggcggcagctggcatagtccttcgctgatgatgccgagcaccatgtcgatgacgctcgcaatcaccgcaataatgcattcgatgacgatatgtctgaagaacggtgcctcaaaacgatcgtacagcatgacgatctggccgccataccagccggcgagcaatgctccggcaatggcgagcgccttggacacgatgagcgtgttcacacagcgctccgaatccatgggcttgagctgcgcacgtttcttcggatcggtggtcgtgtatttgtgcacctgccacgccagatagagcacaatgaagccgacaacgaccatcaccgcgctggcgaggtacgggatgccggccaatcccagcccgcgcgtctcctcaagatgcgagatgcccatgccggcaagtagaccgacgagcatggcgatcacataccaccaccatggagttctgcgtgctttcatcggccgcctcccatgacccaccgttcggattcgacgcccacctgtgcgctgtcgggcgccattgccagcagatacgccagtgggtctccgttatagctggcattgggatccatggcagcccatggctcaagcacggcagcgccgagatgatgatccgccgcacctttcggtgcatgcagtgattcatcccccactttgcctgtggccacaaccgacagctgcacggctccctcgtgtgtggtgtgcagcgcatcgagcacctgattcagctgacgcactcccattgcggtgctgagtttaatcacggcggcatggccgtcggtcccgttgagggagcccacgaaatacagtggggagatgccgtccacttggttgcccggcatactgtcgagtgtgacgatgacctcacggaacagctgctcggcattcagcgcggcactatgcaaagaaatgacggcatcgcggtatgacgggtcgaccggcaatgccccatcatgcgtgcttgcagattcctcgcccccggtattcgcagcggcagcagatgggttggccgaggattgccggtttgcggtgaccgttgcactgagctgttcgaaggtgcgcaatggggccttccaatgcatgtgcacggtgacagtgacggagcggaacaccgattggttcgccagctgcgccgcgatgcgctcggcaagctgttcgacgggcacgccgagcatcatctgcccgatggccgccacatgtgcggccagatcctcggcatccaccagctggtcgtcgtcgatgacccaactgacgtccgccgtccacacacgcatgtcgtcctcgttgctgcccaggtcgatgccgctgcagtccacggttgtcatattcctcgccctcctcttccctgttcgcatgggcgcatatgcgaggaaggcctgggctatgcgctccagaccttccgggttttcgttagaactcctgctgaggcagtccggcggacttcttcaacgcttccggaatagccactggcggcttgtccgaatccgggcggttcgggttgctcaaccacaccttgcgtttcggagccatcttcagattggcgaagatctccttgagttccttctcgttgagcgtctgcttgacgagaaggcggctgaccagttcgtcgagcacctcgcggttctcggtgaggatctgccaggcctcggtgtgggcggtctcgatgagcttgagcacctcctcgtcgatcatctcggcggtggcgtccgaatactcgcgcgggcgcagaccgtcaagaccctggtcgtcgttcgaatcgagccacttaacggcgccgagctgggaggagaggccatacaggcccaccatctgacgtgcgatctgcgtcgccttctcgatgtcgttggatgcaccggtggtcgggtcgtggaacacgatctcctcggcggtacggccgcccatcgcataggccatctggtcgagcagctcgttgcgggactgcgaataacggtcttcagttggcatcacggctgtgtagcccaaggcacggccacgcggcagaatcgtcaccttcgtcaccgggtcggtgttgtgcagggcggcggcgaccagcgcgtggccaccctcgtggtacgcggtgttgcgcagttcgtcgagcgccatgccgcgcgaacggcggcgaggaccactcatcacacggtcgatggcctcgtcgatggcacggttgtcgatgagctgggcacccactcgagcgcacagcagcgccgcctcgttgagcacgttggccagatccgcaccagtgaaaccgggtgtgcgcacagccaccgaatgcaggtcgatgtcgggcacgaagggcttgcccttggcatgaaccttcagaatctcctcgcggccttccaaatccggtgcctccacggccacctgacggtcgaaacggcccgggcgcagcaatgccgggtcgagcacgtcggggcggttcgtggcggcgatgatgatcagatgggtgtcgttgtcgaagccgtccatttcgacaagcagctggttgagcgtctgctcgcgctcgtcgtggcctccgcccatgccggagccgcgcttgcggcctacggcgtcgatctcgtcgatgaagatgatagccggggcattcttcttcgcctcgtcgaacaggtcacgtacgcgcgaggcgccaaggcccacgaacatctcgacgaagtcggaacccgccatggcgtagaacggcacgccggcctcgcctgcaatggcgcgtgcgagcagcgtcttgccggtgccgggagggccgtacagcagcacaccgcgcgggatgcgggcgcccagcgccttgtacttggccgggtccttgaggaagtccttgatctcctcgacctcctgtacggcagcttcttcgcccgcgacgtcggagaacttcgtcttcggaatctggccgtcggcgagcttggcgctcttcttgccgcccatgccgagcatgccgcccgccgagctgctcatacggctcatcaggaaccagatgagcgcgaagaaaatgaggaagggcaccaccgagctcagcaagtaggtccacatgctcgtgctgtgcatcgtggcggtccagccctgcgacgggttagccttctccacggcacgcaccacctgcgcctgctgggcggtggtgtagtagaactgcacgtctttgccgtaattgcgctcacgccccgtctgcgggtcgttcttcttgaagtcgttcttgagcttcaactgcacctgctgcgtgttgtcgactatggtggccgactccacgtcgctggcctgactgttgaggatgttcatgccatcctgcgtgttgatcgtctgcgtgttgtttccgaggaaggcctggaaaatgaagaacaggatcagcacaatgagcacgatgtagagccacgggcgctgccagaacgacctgggggcgttgttgttcccgttggggccgccgttgttgcgcggcttgttggaattgtcgccgaatgggttaaacgggttcggcctgttgttgcggccgcctgaattgttccccggctgattggggtaggtcattgcacagctccttcatacacctcgggcttcagcacggcaatgctgtcgaggtttctgtatcgctcgtcatagtcaaggccgaatccgaccacgaattcgtctggaatctcgaatcccttatatttcacatcaacatcgatcacgcgtcgagccggtttttcgagaagcgcgaaaatctcgaccgatttcgctccacgcgacttcagctcattcaccagccagtcgagcgtgcgtccggaatcgatgatgtcttccacgatgatcacgtcccggccgcgcacatcgcggctcagatcctggcgcaccgtgatcgtgccgctcgatgaagtgcccgcaccgtacgatgacaggctcatgtagtcgagttccacctggatcgacatggcctgcgcgaacgcggtcatcgtgttcgccgcgcctttgagcacgcatacgagcagcggcagcgtgtgtttgtaatcctcgctgacctggtccgcggcttcctggattctcttcatgatctcgtcatgagtgatcagctcatgatcaatttcgttttgcacatcgacgattcgcatgcgtaatatcttcgcatatgcgaatgacgtgagccttacgttttgctgaatatttactgggaagcgcgaccttgccctgtccgtgccactgcgagacgagcttgtccaccgccgccacatgccgtgatgcatatgctagaccgcacgcagccaaggtccgggcgatcacacggtagcgtatcgcctcgggccaccgttccaacgcgcgcgcgtcgatgttcgcaccgagcttgtcatcggcgagacgatctgcctgcagatcgcgcatattcccttcgaattccaccgtctgcgcaagcgcacgctcggcctcttgattgagcgcttcgacatcacggcgcgcaatccgcgctgttctggccaatcgatccaccatgtcgcatccggcgaatgcgctcaggtatggcatgaggtcgtgccgcacgcgcgagcgcagcggatagcttgccggcaacgcggtctctaatggcaccgcatcgccgttggtggggtcatcccagtattccagtccttcgtcttcgcagattcgcgtcgtctgcgcgcgcgtgatgccgagcagagggcgcaataccagcacatcgtcgaacagctgggtttgcggcatgccggcgaacgcatcggttccggcggcacggatcagatcgatgagtatgctctccgcctggtcatccttggtgtgggcgagcagaaccgcagtcgcatgccatcgccgtgcggtgccgaccagcgccgcatatcgcgcctcgcgtgcggccgcctcgatgccctgcccgcgttccttcacctgcacgtccacaatgagcaccggctccagaccgagatccctgcacgtctgggcagtctgttgcgccaccttatgggacgcgtcctgcagatgatggtcgactatgatcgcgccgcaacgaatgccccatgcggcgcacaccacctgtgcgcatgcggccagcgccaatgaatcccggccgccagagcatgcgacgaagacgaacggggcatcgtcatgtggcttgtgttcgccatgtgccgagaattccttggattgctggcccagaccatgggctttgagcacatcgcgcatctcgccgatcgccgccttcatagctgcagagtatgccatggatgccctttcaccatctcctgttcccgaccagattccccggattacagggccgccagccccgccacgaattcgttgatggcggtgcgcgtggcctcgaagtcttcgggattgttcacgatcaccgcgaatgcggccacaccgccttgttcccgcgatacattgcccgtcatcgacgagacttcctgcaggctcccggttttcacacgcgtcagaccggcggcctgtgtcgaggccagacgattggctgccgtaccgacgagacccggaatggaaagtccctctgccgcggccaccgctcccccgacatccagattgcgggcctgcacttgggcgagcgtgttcgcggtgagtctcgacccaggagtgagacccgagcagtcagccatctgcagcccggtcaggtctatgccgagcgtgcgcagttcgtttctcaccgcggcggtggcaccggccggcgagttctcctgcttggtggacaacgccagcagcctgccaaactcctcggcgagtgtgttgtccgaatgccgcaacatgaaggccatgaccatggcgagcggcgcggactccacttcggctatcggcgtgcgatcagcgctcaccgtggtctgcgtgggctcggcattcacaatcgtgatgccttgggcgcccaacaggttccggaagatggcagtgacatcagctgcggtgttctgcgaaagcgccgggtatgactcgaacacgtccgggtttcttggattcgcaccgttccattggcgaccaccatcaatggccattgaggagacaggcgtgtaatagagcgaatcggggttgttggcctcgatgcccgttggcgtgcgatcggcaccgaacaacgaatcatcgtattgcaggttcaccttcgtgaccccccgttgcttgagggcatgggccgtgttcttggccagcgtgagcaacccggcccgcccgttcacatggtccgggtcgctgtcgccggcaccgagcagcatgtcgccattgcctttgatcaccacggtgtcggtgccctgttcggcctgcaataggaatgtctgggttggcagtgtgtctcccatgtcgagcaccgaggccgcggccagcgatgtcagcgtcttcattgtggaggccggttcgcgcgccacatccgccgcatgatcggccaccacggtgccgtcggcctgcatgatgattgccgagacgtctggtcccaccccgttcttcgcgcggagtgcgtcgatgagcttcgccgcctccccggcatcgatggcacgcgaggtgtcggcattggcaatgaaaggggcatcggctgtgagcagatgcccctgcggctcggcaatatgcggttgcacggcggcattggtgaggattccaggtgccttgtcggcgatgtcggcccacacgtaggcaccgcagcaccccaaggtgacgagggcggtgatggccacggtgagtgcgcgacgggcccgtatgcgacgcgtgccgttcgtggcatgccttcctgctgtttgtttcctgcccatgcgccttccgtcaatcgccgagatgaagctattgctgcaacgaggcgaagttgtcgagcgtggccagcaccttcaggccccgtgcatcaagaatcttaccgccaagccataccccgagccacaggaagagcacgccgttggcaagcgagaccggcatgagcacccaattcatgccccagtgaccggtggctgcgagcacaatggccacaatgcccgtgggcagcgccatcacacaggtggcgagcatgaaggcaaaggggaaaagaccctgagccatggcgcgtccttgcggtgatgagaacggtttcctgatcgacggcactgggtacatgaggaacgtggagaagaactcggcgctacccaacgagatgagcactacgccgaagccgaccaccgtgcaggtgatgccacgcatgacaccggccggagtgcgccaatcgccggtaagcgcgtaggtgagcaacgcgcacagcacatagaagatcgccaagtaggccaggtagacacgggtgcgcccccagcggtccactctgccgggcacgccggcaatctgctccatcgcgtaggcgcggccgtcataggcgatcccgttgctttcgccgatgagcatcatgagtcccatccacaggaagcactgccacaccaccatcgactcgccatgggattgcagcgcgaaaatcactatgaacaacacgggcagcacatactgcatggcctggcgggggtcgcgcttgagcgagatgaacaggcgcgcggaaatcgccccgcttgccgaatccggcatccagttgaacgcaccgatcgaacgttccctacgcacgttgctctgcggttcgccctgtagtcgttcgcgacgaatgcaccacaccgatgcggcgaagcacagggcacagaacacgagggcgagcgccacccgcgcaatgcacgcggcggcattgccacgggcggcgtcgaacggcaaccccagactccacccgaacggcagccagcccacaacgtcggtcaagcgaacgagcccattcacgtcaatcgccgagaagtcttcctcggtatgcgtgttgacgtagatgttcggcagttgtgccgcaaccacgacgagcagcgtcaccagaatgtacagcgtgttcttgccgcgctcggtgcgggtgagctgtgaggccaacgacagtgccgccttgctgaagcacatggccaccatgacggtgagtgcggcactcagcacgcctcccagcacggcgcccgtgccgtaccccacgtagaggcgcgaggcgcacagcagcgacaggaatgcgcaggtggccggcagaccggtgaatgccgaaaggtagagtccggcggtgagcgtgcggtctccaatgccgaacaacgagaacttctgcgcgctcatggtggacgattccccgatgagcagcagctgaatgagtgcggcgaagatgatgcccaccgtgccggcattcaccatgaccacccgcagcacggcgaacgccgcctcattccattccaccgcgccgccggtcagcgcgaatgcggcgaggcccgccccaaccacgatgccaagcgccatgaggagcgccagcacatatcccacgacctgccagggacttttgcgcatggcggcgaacatcagcgaccagcgcaaccgcaccattgtcgtgacaatgttgggtcgctcgcctccggcatctcgattcatcggagtgacctgcgcgtctctcggcgcttccatcggaggtgtctgcgtcgcactcatgcctgaccaccgttctgatggtcatcctgtggcacggagacggcctcgtcagccgcatgcacacctccattgagccagtcgagatgcatggtgtcatggcggccgcccaccagttgcaggaagcgctcatcgagatcctcaccaccggcgacctgatccacggttccagcggcgaccacctgccctttgttgatcacggccacatgcgtgcacatgcgctccaccatcgacatcacatgcgacgaaatgatcacagtgcccccggtggagacgtatgcggagagaatgtcgcggatattcgagcttgacaccggatccaccgcctcgaagggttcatcgagcaccaacacgcgtggactatggatcatcgcagtggccagacagatcttcttcgtcatgccggccgaatagtcgaacaccggtttgtcggccgcatcgagcaggtcgaatgcgtgcatgaggtcgttggaccgctccagggcctcggcacgcggcatgctgcgcagcataccggaatagacgagcaactggcggcccgtcaatctgtcgaaaatctggtctggctgcggcatgaggccgatctcacgcttgacggcgttgacatcgtgccagacatccttgcccagaacgagcaccatgcccgcatcgggcttgagcattccggtcatcatgttgatcgtcgtggtcttgcccgcgccgttcggccccaccagtccatagaacgaaccagtcgggatgtcgagcgagaggccattgacagccactttgtcgtcataccgcctatacagaccccgaatggagaccgccatggacgggtcggccggcaccggaccaggagcggcaattggctgttgcataatctgtgtcatatttcacctatatcaagaatcagccgttcgcggcaattacattcacaaatgaactcacgaacggtttctttctccacctaatcagaatctagacagtccatatcggaccatctcacgagatggacatatttagactatctgtctatttcagtctgttggtggaatcgggtgaaatatgatctaccggttcaaaccgaatgctcaggctactcagctggccatggcgcgttcctcgcggtcctgctcccgaatacgcggatcctcggcccccgaggagccctgatgctcgatcggcttccactgcgccttggcgaacacggcctggaacgaaatcggcacataactcagaatgtaaatcgggaagctcagcgcataggcgaacaactcacggttcgaagcgccaatctgcttgcgttccaccaccatcgtgagccccgccagcaccatcatgaacaccatcgacgaaacgacgccgagcatccaattgaacaacgcggcgccctggctcgaccatgagatgaacccgcaggcggcgaagatggtgccgagcaggacgcgaatgattgcaagcaccgtgaacgggcagatgaacagcgtcagatcgatggatgaaaaatcgcgttcctggatcgcacggcgaacgagcgccgggccataatagcggaacacctgcaggaaccccttgctccagcgcagccgctgacgccagctctgtgcgaaggtgaccggctgctcatcgtagaggatcgccgagcccacgtacccgatgcggtcaccatgcagcacagagtccatcgtgaactcgaggtcttcggtgagcaggtggaacttccacccctgattgcggcgcatcacctcctgcgagaacatgaatccggtgccacccacatggcagctgttaccgagccacatgcgcgaggcgctcacgaatctggattcgcgaatgaaccacaatgccgaaccggagctcacccagttctccgaaaggttcaccgaattgcggtagctcgtcagaatgcggaaaccggattggtaggccttgttcatctcctcgaagtaatgcttgtcgaggcggttgtcggcatcgaacacgaagaacgcatcgtattggtcggaggccttcgaatcgatcatcgcgttgagcaggtacgtcagtgcatagcccttgcccacctgctgttggttgaaccgttccaccacatggcagccgaggtcgcgggcgagttgcgccgtaccatcgtcgcagttgtcggccacgagccagatgtcgatgagcttgctgggatagctctgcgattggatgtcacgaatgaggttacccaccacctgttcctcgtttcgcgcggagatgagcaccgcgtaccgcttgtccatcggggcggccgggaatgtgaccggcttggcgaatagggaaacgagaatgcagaatccctggtaggcgatgctcacaccacccacaatgacgagaagcagatcgagaacgtcgagtattgccatcagctccactggctcctagggttctttggtttggttccggttgttgtggcggcggcggaaggctttgcgccatccgaatccgtccgctcagattctaccggagtcgaagattcggcggtatcggtcttgcgaacgatatcgacctcattttgcgactcgcccttgccgggaactcccctgcgtggcttgtgttggagtccttcgcctgcatgacgttcgagcaagtgcttcggaatcgccatggtcggtgattcctccgattcagagtgggcatgtccgctcgcagcgtcgtcttcgcggtcactgccgtacatctgctcacgcagatactgaatatggtcgtcgtcgaaggaaacatgcgcgctggaacccttggcctgtcgtggcatatggtcgctgaccggtttgatcacatgttcgttgatcgcatccgcagcctccaccatcttcgacttcttgttcggctccggatcgctcatcaacggcatgtcgaccagcggataccgtttcatggccaccttgagcagcacctggatgctggcggtgatcggcaatgcgaggaaggcgccggcagcaccgaatatcgagccgaagaacaggacggtgaggaatgcgatgcaggggttcagatccatcgtacgttccgagatcttcggagaaagcaccagattctcgatctgctggtacacggtgatgaacacgacgacgccaatggcgtaaccgattccgcgctcaccccaggcgaacagcaccggcaatgcgccaccgatataggttccaagagtcgggacgaactgcgagacaatgccgcagaacaaagccagaggcagccagtacggcaccttgatgatcatcaggaacaccgacatgcaggccgcattgatcgcggcgaggatggaacgcgagaacaggaacccggaaatctgatcctgcaccacggtccacaccatgaggaagcggcgctgagatctcggagcgatccactggcacacgctccggcgcagcttcgggccggcgatcgagatgtagaacgccaccatgagcgctgtcgtcagattcagtatctgcccaagcacccccatcgtggtgctcaccgcctgaccggcgaaatcggtgacccacgatcccttgatgttcttcatgatctcgccgccaagatcgttcatctcgggcagcttgaaatgggttttcgcgtccacgaaggcggcgaactggttgtatagatcgggcagtcccttgaccatggagatcatctgctgcacgaacatgttgccgaatagcgccatgagcacgatcacgatgaccaacagacccgccaggcaggtcaccgacgcaacgccacgcttccaaccgtgcctgatcagtcgaatgaccaacggctccaccgccagagccaggaacaacgcgatcacgatgtcgaacacgatgtacgtgatcttgccgtacgacgtgaatacaaaccaaccgaggtagacggctatcacggcatagaacaacgcgcggccataccactccggcggcctcctgggatcgccctttgatgggaacagcgatgccacgtccagtttccgcttgctttcctcgctcatgcgcaatattgtaatagtccgcatactcaacgttcagggcgaaatcacgacccgtcagcccgcacccgcctaaattcgccatcatcgtatgtgtgcccgagtgtacgggtgaactcatattgtagaaggcatgctgaaagtctcaatcatcatcccagcgtggaacgaaaaggaacgcatcgtcgattgtctcgacaacgcaacccgccagacggtgatgccgcacgaggtgctcgtggtggacaaccgttccaccgaccataccgtggaaatcgtggagcgctacattgccgaacatccggacctcccggtcaagctgctccatcaggatgaggagcagggtctcattccgacgcgaaactacggactcaaccatgccaccggcgacattctcggacgcgtggatgccgactgcatgctcaagccggattgggtggaggtggtgcggggcatcttcaccgaggatgccgaggcgatgggagcgaccggcccggtcacctattacgacatgcccgcccacaaaatcgcattgcgcggcgacgacagcgtgcgccgccacacttaccgcgcggacggcggtcaggtgctgctgttcggctccaacatggcattgcgtgcttcggcatggaagctcattcatgacgaggtgtgcctcgataaggaagatgtgatgcacgaagacatcgacatctcgctgcatctgcttggccgcggactcaagaccgtgtattccggccgtatgatctgcggcatctccgcacgccgcatggatacgtcgttcaagtcgttccgcaactacatgaggcgtttcaagaacaccttcgccgcacatccggagcattggcgcaatcacaagtcggagcgcacgctgtacctgatgtacccatggctgcacgcgatgttcccgatctaccgccagtacctggaatcgaaagacatcaatccggccgtgcgcatctggttccgcgaacaggccaagctcgcgcgcaaggaaggcgatccgcttgccgacctgccaggcatcgagaagttcgtggaggagacgccgaccgacattcccggtctcgaggagatcgacgagaataccgccttcgacccggatggtgcaccgcaatccgaggattcctcaatcacggggaccacaaccgcgcagtaaccactcagcggtccttatcagggggcgatgtgaattcgcgttcgcatcgcccctgctctttgtcgtatctggcactcggcggatggaatagtgcggcagatgggcctgaaaaacaaaaatcccttgccgaagcaagggattgagtggtggctccgagcggcgtcgatccgctgacctaacgattttcagtcgttcgctctaccaactgagctacagagccagaggctggaacagggttccaacatcgcgaccacggccggacttgaaccggtgacctccgccgtgacagggcggcgctctaaccaactgagctacgcggcctcaatcttaagattcgctagaatcattaagacctagcgaccacgaccggacttgaaccggcgacctccgccgtgacagggcggcgctctaaccaactgagctacgcggccgttgtttctcgatgtttccatcgcgacaacagatgtaaatattactcgattccgcattcaacgcaaatccggcgtgtcgaatatgatggattcgcaaaggaccgcggatcggtcacgacatagcgagattgcaaacgcctgcacctgccgcaagcaaccgatcaccgacgcacggtcagccagaccatgctcacgcgccccgatcctccacctcggagacggacccgcgttccacaagcaccgatggaatgacggtcttgacccccaccggcagcttgtcgccgttgcattgggcgaggatcatcccgaacgcctcacggccaagctcgttgaacttctctcgcatcgtggtcagctcaagccggggaacaatgccctgcagcgaatcgtccacgcccacgacactcacatcctccggcacgcgcttgcctgcctcgcgcaaaccgaggatgcagccgtacgccatctggtcattcgccgcatacaccgccgtgcagtcgcgttcatgcgccagtgccagaccggcctgatacccgctgtcggcctcccagtcgcctatgtacacggacggcggaacgattccctgctgcctcagggcatcttcccacccacgtcgcctgctctgcgccgccaccgaatacgacgggcctgcaatgtggtacacgttgcgatgccccttcgccaacagatagtccaccagcaccactgacgtcccatattgatctgaatcgatcgtcgggcaatggtccgacggctcttccgagacgagcaccaccggcaactcgacactcggcacgaatgtattgaaatccgccacttgctgctccaagatgaacacaactccatctaccggcagcgttttcatctggtcgattgcgctctgcaaagtcgcgggacacccttgttcaaacgaccggatcgtcgtcgcatatccatgctccctcgccgcatccacaacgccgttgaggatgtgcgaatcaccgtatgacgtcatattgaacaggacgacacccacgtccttgaacgacccatgcttcaacgcgcgcgccgcatagttcggcctatacccaagctcttccatcgcacgctcgactctcaagcgcgtctccggcttcacctcgctgctgttgttcgcgaccctcgagaccgtttgcgacgacacgcccgccagcctcgccacgtccttcatcgaaactgaccctgccatatctcacccacttttcgcaaaacgccgacatgtgacaaatatggaatcttcgtcgaagccaatatatcaatgatagcaactgtttgcgcaatcatgcattttatgctcataaacaatgtgagcttaatttgacttgatttccaacgatgatgtactatgtttgcgtaaacattctgaatgcggacacagtagttcgaactcggaagcgcaagcaaggcagacgcaccgctcacagatgaacggtacgggacctcaaaggagaggcaagatgacttctacaacgaaatcgcccgggacagcgggcacgccagatgccgcggcgattgcggcgaacgccgtgacaaccggaggatcggctcgggtgaacaagcatcacgcggactggcggggctggaagtttctatggccattcgccctggtattcgtattcgtgttcatcattcccatcctgtacgcaatctacatctccttcttccagacgaagatgatcggcggcacgcagttcgtgggattcgacaactacatcaaactcttccacgacccgcatttctggtcgtccgtgggacgcgtgaccatcttcaccgtcgtccaggtgccgatcatgctatgcctggcggcactcatggccctggcactcgactcgatgaagcttcacggcacaaagttcttccgcatctccaccttccttccatatgcggtgccggccgtggtgtccacgttgatctgggcattcatgtacggggccaagtacggtctggtcggctcgctgaacgcttggttcggcacgcatatcgacgtgctcgccccgagcgtcctgctggcggcaatcggcaatatcgtgacctgggagttcacgggctacaacatgctcatcttctactcgagcctgtccaccattccccacagcctttacgaagctgcgtccattgacggcgcgagcgaatggcagatcgtcaaaagcatcaagctccctgaactcaagggttcgctggcgatcacggtgatcttctccatcatcggatccttccagctgttcaacgagccgtcgatcatgcagaacatggttcccggcaacaccatcaccacgtattacacgcccaacatgtacgcctacaatctgagcttctccggaaaccaaagcaactatgccgccgcactggcgatcgtcatggccatcatcaccatggccatcgcatacgccgtgcagctgcgcagcatgaaggaccagatgaagtaagactcaaggagagatcgacatgaccaccacagtttccacggatatccaaaacacccgcaatgcgcgcaggatagaacgcgatcgccagcgcagaatcgcccaggacgagcgtgcggaacgcaagcgcagtcgcaagaacggcttcaccaacgtggcaaatccccgcaagtcaacgctgctcaccatcgtatgcgctgtcttcgcgatctactgcctcttcccgttcctgtacatcctcatcaactcgacgaagacacaggcggacttcacatccaccttcggtctgggattcggcaagacctttgcgctgtgggacaacatcaagactgtgttcacctatcaggacggcatcttcggccgctggttcctcaacacgctgttctacgtgatcgtgggcgccgggggcgccacattgctggcgatcatgggaggatatgcattggcgaagttccgcttcccgggccgcaaggccgtcttcgccgtgatcatcggggccatctcggttccgggcatcgcccttgccgttccacagttcctgctgttcgccaagctcggtctgaccaacaccccctgggccatgatcatcccctctctgatcagcccattcggcctgtacctgatgtggatcttctccgagcaggcggtgcccaccgagttgcttgaggctgcgcgggtggacggcgcttccgaggcgcgcaccttcttcaccgtcgcactcccattgctctcccccggcatcgtcacctgtgcgctgttcacgatcgtggcaacatggaacaactacttcctgcccctcatcatgttgaaagacgcgaactggtaccccctgaccatcggcttgaaccagtggaaggaccaggcctccaccgcaggcggacaggccattcagaacctcgtgatcaccggatcgatgatcaccatcatcccgctcgtagtggcgttcctgctactgcagaagtattggcagtcgggtctggctgccggtgcggtcaaggaatgacacattcgcgttcaaccatccaatgaagaaggagtgactccatgtcagcatccacacaacatcgtgcgcaccgttggccacagcccctgccaggcaacgaccggaaaatctggttcggtgcggactacaaccccgaccaatggcccgaagacgtacaggacgaagacattcgcctgatgaagcaggctggcgttaacatcgtatccctggccatcttcagctgggcgaacatcgagacgagtgacggcaatttcgaattcgattggcttgatcgcgtcatcgacaagctctacaaggccggcatagccgttgacctcgcatccgccaccgcttcgccgcccatgtggctcacgagcgcacatcccgaggtactgcggcgcgacgagcaaggccatgtcatatggcccggagcccgtcaacactggcgtcccaccagtccgacattccgcacatacgccctgcgcctatgccgcgaaatggccgaacattacaaagacaacccggccattgtgtcatggcacgtaggcaacgaatacggctgccataactacttcgactactcggatgacgccgtgcaggccttccgggagtggtgccgcgaccggtacggcacaatcgacaaggtgaacgccgcgtggggaacgaacttctggtcccaacgactcaactccttcgaggagatcctgccgccgcgttatgtgggcggcgaaggcaacttcaccaacccggggcgcctgctcgatttcaagcacttctgctcggacgcgctcaaggagttcttctgcgccgaacgcgacgtgctgtccgaagtgacgccgaatattccgctcaccaccaatttcatggtgagcgcgtcgcagaacacgctcgactacgatgactgggcccacgaggtggacttcgtgtccaatgatcactatttcacccccggcagctggcatatcgacgaactggcatactccgcctccctggtggacggcatctcaaggaagaagccctggttcctcatggagcaatccacctccgcagtcaattggcgcgagatcaacccccgcaaggagccaggtgagctcatccgcgactcgatgctgcatctggcaatgggcgcggacgcaatctgctacttccagtggcgccagtcgcggtccggtgccgaaaagttccactcggccatgctgccactggcaggggagcattcgcagatctaccgggatgtatgcgcattgggcgcagacctcgacacattgagcgatgccggcatactgcgctcgaagctttcaaaggcacgggtggccattgtgcaagacatccagtccgaatgggccaccgagcatacggccacacccacccaacacatacgcgaatggacggagcccctcgactggttcgccgccttcgccaatcgcggcgtgaccgcggacgtgacacccatccacgcacaatgggatacgtatgacgccgtggtgattccctgcgtgtacctgttcagtgaggagatggccgaacgtctacgcacctttgtcaggaatggaggcaaggcattcgtcacgtactacagcgcactggccgatgagcacgaccgactgcacacggaaggctggcccgggttgatcggcgacgtcgtcggcgttcgcatcgaggaacattgcccactcggcacgctcttcccgggaatgctcgaccacctcgacgtcagcaacggcacagtcgtgcatgatctcgccgacgtcatagacgcaatcgccgatgacaccaccgtgctcgccaccttcgaggcggatccggccacgggtatggacggtagggccgccatcaccgtgcacccctaccacgaaggcggcgtggcctacattgccggcaagctgggcagggacggcatcagccagagcctgccggagatatgtgcggcgctcggattcgagctcgatgcagacccgcgggccggcgatgtgctccgcgtggttcgggagcaggaggatggagccatcttcgaattcctgttcaaccgcacccgcaacactgtcaccgcagaccgtcctgctggagacatgctcatatgcagcctggcaacggacagcaccgacaaggtcaccctcgagccaaacggcgttctggcgttcaggcgctgaacagccccacaccttcgcacacggaggcagaacacccacaaccgaatatcacgatgatgcaatgatgtgcgacacaatagatgtttacgttgcacatcattgcattcatcaatcttcaaatgtactgattttaagctttttcgcatatgtttgcgcaaacataaaatcggtgctacagtgttcatcgacaaggttcgcgaatgcatgcaacggagcaacgcgcgaacatggagaaaggaagaacaatgaagttcagcacacgcgcaatcgccttcctgggcgcaacagccatgctcataccattggcagcctgtgggggtggctcctcgaacagcgggcaaccatcacaggaaagcaacgtcaaggaaatcgacgtgtgggcatgggacccctcgctcaagcaaatcgcagccgactacgaaaagaagacaggcatcaaggtcaacctgaaaaacgtgggaaccaacacgaaggaatacacccagctcgacaacgcgatcgaagcggggtccggtgcccccgatgtcgcccaaatcgagtactacgcattgccccaatatgcgatcaagggaaatctgcttgacatcacagataagacgagcggatacgaagacttctataatccgggaccatggtcgtcagtgcaaatagacggcaaggtgtacgcattgccaatcgacgcaggccccatggccttcttctacaacaaggagatcttcgacaaggccggcgtggacggcgagaagatcaagacatgggatgactactacgaggcggccaagaagattcacgccctcggcgatgaatactacatcacttcggacagcggcgatgcaggcttcttcgattcgatgacctggcttgcaggaggcaaaccattccaaaccaccaataacggcaaggatgtgacaatcaacctcaccggagacaatggcgtcaaggaattcgagaagttctggcaaaagctgcttgatgagaagctcctcgacacgaagaccgtaggatggtccgaggactggttcaagggcatgcaggacggcacaatcgcatccctgctgaccggcgcatggatgcccggaaatcttgtcaattcggctccggctgccgcaggcaaatggcgcgtggcactgatgccaacaccgaatggggagaaagccaatgcggaaaacggaggatcgtcgctggccgtgctcaagtcctcccccaaggctcaggcagcctatgacttcatcgagtacgtcgctcatggcgatggcgtgaaaactcacgtcgaaaccggcgcattccccgcagacaaggcctccctcgaagccgactatttcaagaacgccaccaccatcaagaactccgacggcaaggaaatagactacttcggcggtcaaaagtacaacgaggtcctcgcacaggcctcggcggacgtccttacggggtatcagttcctgccattcgaggtgaaggcccgtggtgtcttcggtgattacctcggcaaatcctacaccggcaaccagccgctttcggaaggtgtggccgcttggcagaaggcactcatcgactacggcaaggagcaaggcttcacgatgaaggagtagcgcgattctaggagcgttgcggcagacacacgggcaggggcgccaaccattcgaagaaatggttggcgcccctgcccgtgtgtctgccgcaacgctcctagaagaagatgctgttcccggacgccatgaatatgaacgagaacagccagatgacgacgctgatcacaatgccggcgatggccatgccacggctcttctcacccgtcctgttgatctgggtgagcgcgatgatcgacaggatcagccccacaatcggaacgaggaacgagcacacgaaacccgcgatgcacaaaccgttccatgtcgtgggctccggcgagtaaccattgccgtactggctttggttgcactggccatacggagcgtaattcgacatgttctgcgtgtagtccggctgcccgtactgctggccgctccctcgggcatattggccatactgcggctgggcatatggttgctgggcattgccctgcgcaccatagtcaccatactgtggctgggcaaacggagtctggttcggctcttgctgcatcggcggttcacttaatccccgcccatatggattgttcgaatcgtaattcggctggtaattcgtcatgcctccacactacaagccacccccctcgacgcattcggcgcccatgccgaagcactcatgcacgataccgatgccatatgggagcccgcaaacccgcaatcgaaacggggcccgacctttcggccagaccccgcaggaatcggtttcgcggatgaccgttatgccatccgcatggaatatcatgccgttttcatgagctggtccacagagcgtatatgcgcaaggtaatctgcacccacctcgtcgaactgcgagtagtcactgtgtgtatcgtagtggtactcgtaatcgtcccatcctgtttcggcgagcgcgccgagcccaatcgccaatccgcagatgaccatgatgatcgcaatgagagcgagcgccgtcgagatgccgccgatcacaatgccggcgatggccatgcctcggctcttctcgccggttttattgatctgcacgagcgcgatgatcgaaagcacgaggccaacgagcgggaagaagaacgagcagatgaaaccggcaatgcacatgccgttccactggtccaccggagccatgggataaccgtaggcaccctgtggaggatactgctgcgtgtagtttggctgcggagtcgcatactgtgccgtgtatgcctgctgagggacctgtgagtagccggggtctccgacgtacggattgtcgccatgctcattggggtccggagacgagtacggtgagccgagggtatcgtttgcagtcatatgcaaagcatactgcaagaacgcacggcataggcgcatattccaattccgtcccctatccccgcatgctcctcattcagcacgatttcgtacataacgccgagagaagactgcgcatcgcatcccgtgcagacgacgtaccgtggaatcagaaaacgcgcacatgcgcgggaaacgaggtagacatggcagaagacaagaccagtgatgagctgaccgaacgcgacatcgaggatctcaacgatccagacgacaatccggatgtggctgatgcggatgcaacggaacataatctgcggcgtgcggtgatcatctgcttcatcgtgacgagcgtgatgtgcctgtgcatcaatatcgtggtgcttctgatgctgcagcgcaagggcaaactcgacaaggcggccgccaatctcgacgagttcaaggagaacatgcagcatctggccagcgacaagagccgccagatcgcccggaacaaggacgtgcgcaaggcaatggacacgatttcgcagcatattcgcgagattccaagcgaggcgcagagcgcggtgacccgcgtacgcgattccctcgcaaagtaggccggttcaacacggcggtttccgtcggggcctgcccatatgggcaagccccttcccatatgtattcgcactggcccgacggactcgatatgccctgcgcacaatgatggcgcatggattcgcggattacccgagtatggcctgcatcgcctggtctgcgctgaggaactgcacgccatgcatgcccgattcgctcgccgccttcgcgttctcatatttgtcgtcgaagaacatggcatgtgccggatcgatgccgaagcgttccatcgcgatctcgtagatgcgcgcgtccggtttcgcgcaacgcacctctgacgacacgaccgtgtcgaggagcagacgcagcgccgggaattctctgtgtgcaagcgtgacgaacggcgtgctgaaattggtcaggccccagagtctatatccacgttcatgcagcgtgcggagcagttccggcatgccgtcgaccatgccggcgaacgcgcgcgtgtaattcgcgaaatagagttgcattgcgtggttgagcgcgacatcgtgcgggtgatgtcgcgcgaaatcgcgcagcacctgctcctcgctccagccgagatcgctcatcagatcgtagtgccagaatccgtaaggatctgcatgatcgagcagacgccgcatggtggacgtgtcgaccttgccctccatggtgagctccggccgccaatcgagcagcactccgcagtagtcgaatacgacgtcggtgatcggcatgtcttctcccgtccgcctgcagcaggcattcacataccagattcctccactgcaccgccggccgctccactcgccgcgcgcaccgaatcgtcgagcaatattccaattcctgcatgaccacttcccttctctcgatatctcgatcctgccggaagtgggcttgccgctcgcccacgcacggttacggtgcagtaaacaaacaaagtggtcagattaatggcccggtacctgttgcacgagcatggaacacgggataacatggcggcggtaaccgccacaggcagcttgatcaaaacacgtcccgcatcgacggagggcggcggttcggagcgtggtagattaatgtaccgaaggatcgggtctgccataccgcaatccgttcacgcacgccccatcctcaaccacagaccgctcacgcagacgaaggggatccatggtcactcgcaaagacatcgccgagcaggccggcgtctcgcaaagcactgtctcccgtctgctcaacggtgaccccaccctcaaggtgaaggcggacacacgccgcagaatcatgcgcacggctgcggaacttggctaccgggcgttcacgagccgttcgatagccgtgctcaacgtgccgccacaattcgacgaattgcaggacgcctatttccagtcgctgcaaaccgagttgcgcaaggtcgcagccgagcagggcacgacgctcactttcttcgactcgatagacagtctcatcgcacacgccgacgaccacgacggcttcgtcgccaccggacccacctctttccagcgcaccgatctggcccacctgcgcgacgcactccgctacggcgtgttcattgacacgaatccggcgccggactggttcgattcggtacgccccgacctgagccaaacgatgctcgatgccctcgatacacttctcgtcgacggttacacgtgcatcggctacatcggtggcgtcggctcgatcatgggcctgcacaaccacaccgaagacattcgctcgctcgcattcagcgactggagcaagcgcctgggcctgccgaacgagcagtatatctacgccgacggcccgttcaccgtgagcaacggacgcgcactcgccgctcgtctcctcaccgaccaccccgacgatcttcccaacgcgctcgtgatcggctccgaccctatggccgtcggcgtgctgcaagccttcgcagaggccggcgtgcgcgtgcccacggacatcgccgtcgtgagcgtcgacaatctgccgatcgcgcagtacaccgcaccgccgctgagttcctacgccatcgacctgcatgaactcgtctatgcggcgctcaccacactcaccgacgccatcgcgcgcgacaggcacgtgcgccggcatgttctgctgagcaccgagcttgttcgccgcgaaagtctgccaagcaaatcatgactcatacgtgcgcgtgcgcactggttggtcatattcacagactcctccgcatgacgaacccgtgcacacagacacgggttcgtcatgttcggaatgcatgagtcagagcatgctgattgtcacggccagcttgagcggttcgtctgccggcagcagataccgatcgtgaacaggagcgccccacgagtcgtcgccgcccacgcccatctgccctgcgagcaggcgcaggaacatatgacgtggttgcgccaactcgttctggtgtgtggcattttcgatctccaacgaactgtgcggcagcaggctgagcgcgagcgagtcgtcggcctccacgagcagcccatggcaatcggcgtcaaacacataggcccaacgcacatcctcgtgattgccggtttcctgcggcaccagatacggcgccatgtccgcctgcgccgtggtgttccagatgccgagcttggcgcgcttgcggtcacggtaggtctcggcaggcccccgaccatagaattccagattctcatactgtttcggcagcatccactccaatccgaaagccggcaggctcggcgcacccgcacaccccgtatactcaagttcgatatgcatgcgcaactgcgaatcgatacgataacgaatcggcacctgcgtctgcgcgccgtctgccaactcataccagtactcgccgcacagatctccggtgagctcgtcgcggtacacctggcccacgccggtgacgacgcgcgcataccgcccggcaccgaaccactgcacgcggtcgaaaccggagctcatgccacggtcgttgtcggtgagcgggcggaacgtgagcagtttcggcacacgaatcacatattcacgctcaccgtcgcgcaacgagatgactccgccatgcgtgcgcgacagcaggatctcacgctgcccaacacgcactccggcgttccatcgcccgagagtgacgatctgcagattgtcgtcatcgaacgcatcattcatcttcgacccgctgcggccactcgcatggggacgcaccacggcctgtccccatgcgatctcataccccgcttccgcccaggcggtgtcatgcgccaactgctgactcacctcatacaccacctcatgcatgacgccaccgtcgggcagactgtgcacgtcagggaagccgatgtcgaagcttcgggcgcttccggccgccacctcgaactcatagctcttcgaccatgcctcacgtccgtccagaagcatccgcgccacaaacacggtgcccgaggtgccttggaacgcattcgtattggtcacgcgcacaccgcgcccatccggttcgagacgcacgccggcatattgtgccttcacctcttgcgccttcgccgacacggtccggtcggcgaacacaatgccatcgccgctgaactcgtaatcactcggcctgtcgccgaaatcgccgccataggccaggcgttccgtgccgtcgtcgagccgctgccatagtgcctgatccatgaagtcccagatgaagccgccttggtattgcgggtagcgctccaaggcgacgtattcacccagtcctcccaccgaattgcccatcgcatgcatgaattcgcaggagatgtacggtttcgccggatcactttccaggtattcgcgaatctcatcgggcttcgcatacatacgcgattcgaaatcgctgatgtcgtcgtattcacggttccaggtcacgccctcgtagtgcaccggccgggtggggtcgagctctcggcagcgattccccatcgcgcggatcacatcgcccgcgtacgattcgttgccgagcgaccacgcgaccacgcacgcatggtttcggtctcggcgcaccatgctctccacacggtccacgcaagccggctgccaacgcacgtcgtcccccggtatcgagacgccatcggccgtgtcaccgggcagattccagctgccatgcgtctccagattggcctcgtcgatcacatagagtccgtattcgtcgcacagctccatccaccgcgtctgattcgggtaatgcgaggtgcgcacggcattgatgttgtgccgcttcatgaaccgcacatcccacagcatgtcctcctcggtgacgctgcgtccgcgccgcgcgtcgaattcgtgccggttgacgccatggaacacaatgcgttcgccattgagcacaagcacgccatcgcgaatctccacatggcggaatccgatgcgcgtgcgcgcggtttccagcacacgaccgttcgcatcgcgcaccacagcctcgagaacgtacagattcggctgctccgcgctccacggcagcacctgttcgcatgtcgtggcgtagcggatcttcggagcagattccaccgtcgcgctccacagcagggccgcgccgtctgcgtgctcttcccatgtgctgagccgcagctccacattggccgcacaccacgccccgtcgagatcgagttcgacggcgagctcaccgcactgcgcatccacattccaatccgcatgcgcaagcatgtcgcgaacatgggcgtgaggtcgcacctccagctccacgtcgcggaacaatccgtggaaacgccagcaatcctggtcttccagccaactcgcactcgaatattggaagcacgccacggcaagcagattctcccccgcatgcagcgcctcggtcacatcgaactcgctgggggtgtaggaatcctctgcgtaccccacgaacacgccgttgagccacacgtagatcgccgtcgccgcaccgtggaaggtcagactcacgcgctccccgcgggacagcgcctcgcccacgcgatcatcggcagtgaacgcacgccggtacagtgcgaccagattgtctgtgggaacggagggtgcctgcggattttcatggccatcccacggatattggatgttcacatattgcggacgcatgagcccctgcatctccagacaccccggcacctgcacacgggtgaagtcgccatcggcgaagctgcgcgatgcgaattccggcggaaggtgggcgtgctgccaatgctcatccaagccctccgtggggagccgatccaagtgcgagggcaccaccttcaccgcccattcgccgtcgaggtgctgcttcaacgcgccggactgatcgtcggcgcaattgtggtcggtatgccccggcagccggttgaccgcgaacacacggggatcggtcagccacgccgccgtcggctcttcggatcgcagagctccatcagtggacggcacatcattgcgcgggggctcggtcgccttctcctctgcgacttcctgcaaggtctcctcgttcatcgttgctcctgactcgcatttgaccgcggcaccaacgctggtaccgtcggctctgtacttcggtgtactacgcaatagtaaactatttaccaatatcacgcaacaagaattcagcacattgcgcaatctcttcatagacagacattcacacagaaagagcatatatccatgaaacatatatcctgagccgattttcaaatactgcagcaatcgataattagacagatcgacaccaacacacggtaaacaaatttagtaaatcatgtatagtatatgaactgtaatcgccaatgaaggaggttaggtcacatgaccaccaacaaattccaagcgggtgccgggcagacagcgtcgtctgccgcatcctccgacatgctccgttcgaccaccccgaagaccgcacgacacggtttaatccgccagcgcgcggccttcgccttcggcaatcttggtcaggcggcgttctacaacgccatgagcacgttcttcatgacctacgtgaccacggcgttgttcgcgcgcaccgacaaggccgtggccgcgcgcatgatagccctgatcaccggactggtcgttgccatccgcatcgcggagatcttcctcgacccgatcttgggcaatatcgtcgacaacacgcgcaccaagtggggccgtttccgcgtctggcagttcatcggaggcattgtgccctccgtgctgctcgtggtggtgttcaccggcctgtttggactcgtcaacgtgaacaccacctggttcatcacgctgttcattgtcacgttcattctgctcgacgtgttctactcggcgcgcgacatctcctattggggcatgattccggcactctccagcgattcgcatgaacgcagcgtctacacttcactcggcacgctcaccggttcgcttggctataacggcatcaccgtcgtcgtcattcccatcgtcagctacttcaccttcaaattcaccggcgagcagggcgaaggccaaccggggtggactgcatttgccatcatcgtcgcactgctggggctcatcaccgcgtggaccgtcgcattcggtacacgtgagagctcgagcgagctacgcaaacaggactcccattgcggcccacttgacgcgttcaaggccatcgcccacaacgaccaactgctgtggaccgcattgagctacctgctgtatgccattgcgaacgtggcgaccaccggcgtgctgttctaccagttcacctatgtgctcggcatgccgcagcgtttcgccatcgcgggcgtgattcccgtgatcaccggcctggtcaccacgccgctgtatccgttgctcaaccgtgtgatcccacgtcgatggttgttcgccggaggcatggggctcatgattctcgggtatgcattgttcattgcggccccgcgcaatctatcggtcgtgctcgtcgcgctcattctgttctatctgcctgcgcaaacgattcagatgaccgcgattctcacgatgaccgattcgatcgaatacggacagctcaaaaccgggcagcgcaacgaggcggtgacgctgagcgtgcgaccgatgctcgacaagatcgcaggcgccttctcgaacggcatcgtcggcttcgtcgcagtggctgctggcatggtgggatcggcttccgccgcggatatgacgagtgcgaacatccatacgttcaccacttgggcgtacattgtgccgtccgccggcattgtgctcagcctgatcgtgttcctgctcacggtgcgcatcgacgagaagcgccatgcgcagattgttcgcgagctcgagacgcagcttgctgactctgcgaacacggaacggtgacatgaccgcgtcttgacaaatttgcacaacgacgtgcaaaaccagtgcgcgcacctttcttctcctagggtgtgcgtacccccctctatccacttccgaaacaacttatcccaatagcggaaaacacgaggtagcacacagacacggcgccaatgaatctgctgggcaatagaacaagaacggcatcctggcgggccatcgcatacgacacacgcattcagtccgtcgtataacaatcgcccatgcattcgaagcggcatacactgtgtgtcatggcaatgattcaactcaaacgcgcatatgcaccggccgagccggatgacggataccgcattctcgtcgatcgcctatggccacgtggcatgtcgaaggcgaaggaacatctggatctgtggatgaagcagatcgccccgagcaccgacttacgcaaggcatggaaccacaatcccaacacgattctggaattcgccgaaagctaccggcgtgaactcgacgccaatcccgcagtggagcagctcgaacagatccttgccgaccatccggtggtcactttcgtgtatggcgcgcgtgacccgctcgtgaaccatgcacgcattctacgcgactacgtcgaggagcgccagaaggttcaatgaaccgcccgctcctccgatccgatatgatggaatgagttccgcacactccacaaacaggggacttccagtatgacggagcacactgatgcgaatcgtggcaccagtcgcctgcttatgaccatcgggtggatcatcctcggcatcggcatgttgatcgccatcgtgctgcgatgcaccgaccaatatggattcatcacgggattcatgctcatgttcgtgttcccggtgctggcgctcgcggcaaccgcgaccgccacggcaggttcggtgcatgggtactggctcggactcgccgcagcggccgtcgaaatcgccatactcgcttcagcgacgcgtggtatcgacgtattcgcactgtatggcggcatcactttggtgtgcgcagcgattggctatggcattggtcggctcttgcaccgtcacttccatcgctccggcctgcgctgatcaagcgcatgaattcagcaatcggaatgcgttcctgctcgatgcgcggcacggcaagttcgcccgtgcacaggtcacggtacagcgcatactcctccggactgagatgcagcccatgcttcggttcgccgcagcgaatctcatggctcgccgcatccctcgtcgtgccgaaacgctcgtattcggcataggtcatgcgatccatcaatacgctctcacaagcgacccccgaagcccgcagcccactgagaatctcgaatcccgcagcatcgatgtcgccccaatacacaacgcgcaccccatcaccggcaagccagggcaacagttcgggtacccggttcacggcgaatccggagccgaacacacatacggctccgtcaatggggcccatggcttggtaggtgtctttgttctccacaatgacggccagcgagacggggcgttcgggaacgcactgcaccgaggtcgccacacggtcaggttcggcggcgaaccgttggtccatgtaccggtaccgcacctcgcccgggcgttcccgcagcggcagccgatccacaccgagcactgtacagatcgccgcccgcctgcgggatcgtgaacctgccagccatttcgccgaaaacccgggcaaggggatctcacgagcggtgagccccggcacttcggcccaatgccggccgaaccactgcgcggcttcgacgaacaacccgaaatcgacgtcggattcgttgttcaacctgcgtaccacgtccatggcgagcgcatggtcgacatggcatcgttgctcgagctgcgccgctctggccaacactcgttcgcgagggcgtcgcagcgtaggccccgcaatggcgagcgccgtggcctcgtcaggcacatggatatgcgcgacaagcgacacggccgtgcccattttgcgcgagatgaagtcggtttggcagccgaatcgtgccgcgaactccttcaacgcattattcgccgcatgcacgccggccacatcggcgacgagctgcgtctccttgggccacggaatgtgaatcgtgcgcggccatggactctcggcggcgaacaactcgcgctgtacaatgcgcgccacatcgccgcgcacatccgccggagtcttgagcgtcgccgtatccgtcactcggaccgctcccccatcgaggactcatcgccatcagcgtcccccagcagatctccctgcatcagcgtcgtcctgccgctggcctggtccttgcgcgccacaatgaccttcgaagccgaacccatgatctcgccggtcttcgattccggtgccgaaacgatcacttggaagccgagtcccggcagcacgctcaatgcacggcgcgtgtactggccgtcggctttgatgagcgcctcgtcgaggaagacggtggcatacgagggttcggttgcgttgtcggtggcgagcagatacatgagcgccgcgccgtaggcgaacgacgtgagctcctgcaaatagccgcccgagccgccgccggtggagttgatcgattccaccacgccatccgggttcgtcaccgacccgaagaaccgtgagcgtttgcgtgggtcgaggttcgcgttgccacgtccgttgcccgcatattcgtcgaagctgccgcgcagcatctcgatgagtcccgcaaggccggcgaacagctttcggcacctctccacgtcatgctcgtcgtttgccttgaacgcattgatgcggccgatttgcccggtgagtgccgtggtgaacttcgcatcgggcctgtgcacctgcacgacgatcgacagcctaccgcctcgcgccccgaacgggtaccgttcaagcagatggttgattttgccgatctgttcggtgatcctctgctggtcaagtttgagcatcgtctgcaactgcacgaggtcctggagcatcttgtcgagcgagttcatgtactccacgttcgtcgcctcgtcgccgatcacccctggtttgagctcctccaggtctttcctgaagtaccgctcgttctccacctcggcgctcactcgttcgtcgcctgacgcatactggtcgaggtacgagcgcatgctcgcctcgcatgaccgtttccggttgtcgcgctgtgtagccagttccttcacctgcctgcccacggtttgggcgagtgtgccgagcagttcgcgtacgtgtttggcgcaggcctcgttctcgcgtacatggccgcccagtgaggtgcaggattgcccgtccaaaccgagtattctgcccattcgttcgttcgccgattgtgtgctctcgccgaagtatgccagatatccccgttcaagcagccgaccgcatgcctcgttcaaaggccggcgttccacggattgcgtgcgccggtcatacgcttccagccactgccgggtcgacctcaccgccgcattcgcccgcttgagtttgtcttccgcggcatagcatgcactgttcgccttggccatttcctgctgctggactttcagcgtggcattgagctgtgccagttcggggttctgctcgagttcgtcgacgcgttgttggaggctggcgatttcctcctccacaccatatgcgtctatgtcgttccatgcatggtcctgcagcgtctgggccagactatggcgttgctcaagcgcgttgagttgcacgtcgtactgttcgagatcgcgagttgcggcatcccgcgtcttgcgcgcctcggcaatgtctgcctccagatcgcgcagataggcatcggtgacgaatccgatgacggcaggcatgttcttggtgccgtgactgcccttccgaccttccttgatctgcccgtcgcgctgcacctggcgcgtcgtctcattggtgtcgtcgatcgcctccacgcaccatgcgtcgtaccgcgcctcggtcacccgggcacgaagccaatcggcgaacggagattccacgttgaacgtgagcttgctcgacagccacccttcacgctcctcagcctccacatggacgctcgtgtcgacgaaccgccagttgcgtcgtgggagcgcctcctggggaatctgcgagactttcgctgcgaagccgttctcatggcaactgtcgaccagaatcaccgttgcgagcgaccggtatgccacgttcatggcggtgcgccactcctcgttctcctcgcccacgtccatgagctccgccgcataaggcagctcctgcgggctcaggccggtggcgcgcgcaatcatattgcgggcctcgtccatatcgctggagatgcgcgtcttcgactggcgtttgcgttccaagtccttctcgagtgccttggttcgctgttcggctttcttctgggcgtcgatcaatgggtactgcaacccgtgcaattcggttttacgctgctggtattccgattcgaattgcgtgtattcggccaccaatgcatcccactgcccgcgactttccggcaatgcttcgccagaggcactgaatcgggaggccaacagctccctgcgtcccaacacttcgcgttggcgccgttgtgcatcgcgaatgcggtcttccagacggcttatctcgtcgcctcccataccctgaagctgcctattgagcgagtcggcctgttcccgcatctgctccgcccgctctttggcggcctgtgcactggcactgcagtccgtggcatgctgctcatattcgggcaggacttcggtgatgtcggcatgaatgcgatcgtcaagccattgggtgcgaatccgtgcgctatcgccctgctcgggggcgatggtggaaagctcgcgcacaccgcgttcggcggactcatactcggcgaactcggaggcaatcgcctccagctgccgcactcgcttgcgcgtacgctccatactcgagaaattctcggcgaactgttcgtaatcatcgatggcgagcttgccgaactcaacggcgcgcggctcattgagcacacctttgcggaagatgtcatcgagctgggagggcgcgtcggaggcctgcatgcggtgaagcagacggcacgcggactcagtgaggccgaatcgtttccagatgtcttcgtggaactgcttcgcgtagttatacacggtgacacctgggtacacctgcttgataagcggtaccgagaagcgctcctcgcgatgtgcatccatgagccgcgggtcgattgcatagccggagaccacgtagagcttcaccatgctctccggcgcgccgtccgcaggcagatacatgaacttggcaatccataacgcgccgctgttggcggtgtcgacatagtggtcgacgatcgcaccccataccgcgtacggctccccgttcccgctgcgcccgcgcaggtagaccggttcgtcgtgcccgttgttgttgcggattcccctcagccccaacaggtatgagtagtcgctgcgatcggagcgtccggcgttcgaggccttgttgaatgcggcattcgccgggtagagcaacgagacctgcgcatcgacgagtgtggattttcccgattcgctctggccggtgagcaacgtcaccgtatcgtttccggcggtggaaggctcgaatacatggtagccgtcgtaggaaccccaattcaccaattgccgcgaggcaagcgcccaatgcggcggcatgagttcaatcgaggcatagatgtcggaagtctcgctcaaaacagcgcctccatatcgtcatcttcggggtgttcgtcttggccggtatgcccggagccgtcggaatcgtcacctgttccatccggttcgggctgtgcggtcgatgcgtcgtccgcgccgagccatgcggcgatgcgctccggattgagcaccacgggcacgagtttggtgatcacatacatgccttcgtcatcttcgacaggcgccaggaagccgttgttcttcgcactgccgatcaggcggtccacctgcgcctgcaccgcctcctccgaattgcggccggcaagcgggcccgcgccggtggacatcgtgttgacgatctcctccttcgaaatgagccaatcggcggccgcggcgcccacattctcgtagtcgagcaccttgcgccgcagcgcggccagcatcaccgcctcacgggcactcaggctggcacgggtcttgagcgatcgtatgccgtattcatcggcggtgatcggctccgcatacatcacctcatagtaggtgtcgatgaccggcacgagcatgtcgttgttgagcgaacgccgcacgtgttccatatagtcgagtgcctggtggtacatgtcgccgctgatcgacctgttgcgtttcagcgcaatcgcagcctcacgggcgggtgcgggcatgtcgccgatgtcaccatcgaacagtgcgtgcacattggccagatcggccatgccggcctcgtcggccacaccttcctcatactcggcactgagcaccttcgagaccatgcccagattggcatcgccggcaattccctgcccggtgctgtcgtccatcgccatatcagtcctccaccatggtatcgtcgagaaaatccttcagcacctgcccgggcacgaacagcgcgcaggtgcgccatacgcgagtccgaccgtcggtggtcacgcaatgccatagactctcgcggggcacgggaatctggccgccatcgctattgccagcggcaccggcaggcgacgcggaacccagataactcaggaagcccacgatttcgctctcacggcgttcgtcggcgggaagttcgttgaaactggctgcgatgtcgacaacggaatcggcgagcgcatcgccggcatcgtcgatgagcaccgggtgcgcggccaccaattcgatcatatggtggatgcgtgggccgccggccgcaacgatgccattgagatcgacctgtgcgatgccgtcgtccgcctgcatctgcagttcgggagccgcggttttcacgggtgtttcacgcgcacgggtcggcaatgtgagcaacgaggtggtcgccgtgccaatgtcgtagcggcctttcgcatgcaccgactcacccaactgggtgaacagcttcgcgagctgacgagacatcgtgcggaactgcatgtcggtctgctgcctcaccagaagcttcacgctttcgtcggtcacacgaatctggtgacgcacatcgtctatgccgtcgtagatgtcttcgaactcccgattgaccacgctcatgaggtcgtcggcctcgccatgcagccattcgctgttcgagatgtcttgcagcgcctcattgagctcctcgcggctctgcggggcatacattacctggaatgcatcgttgaagcggcgtccctcgtcgctgagccggtacgtgcgctcgtattcctcgtggtagaacgtgagcatgtcattgctgctcatcgaaccgtcgtcgatgcgccgtcgcaacgcatcgccattgtcacgctcggtgatcaccaactcacgcaaatcgacaggcacaccgcgcagcgtgttgtacacgacgttgatgatgtcagacacctgctcgcgagtgggccgctgcccaatgccatgcgccttgagattgtcgatctggtgtcgccgctcctctatctcgcgttcgagcagctcaatgcgctcctccacattcacggtgagctgtttgcgcgcgctctcgatctccatgatgatcgaattcacctgcgcaccggacagcgacaccgtgcgttgctgaagcgttgccaatgcctcgatggctctatgggcacgctgggtcaggcggcacatgagcctgtgctggcggcggtcgatcgaatcggccacccacgcgtagtcgccggcatcctcggctttgagctccttgagtatgcgccgggcggccatcatgtcgtcctcgccctcacgcggagtgtaggtgccatcggcggcgagctcgccgatcgcctcgcgcatacgcgccagcagtcgctcctgcgggacttctgcagtgagcgggtcgaagcaggcgcgcagcatggcgatgtagatgtcggaatacttatgcagcagcatgcgcagcacgccggtctcatacaccggcctcaactgcgccagctcgctccgcacatccgccatgccgccgctccttcccgtccttgtattctaccgaatccaccgaatgccgcaatcagaacagatcaccgcattcatctgcggctcacccttgtgcagatccttgcgggctggccttatctctccacgccggtgtcttcggcgagctcgatcccgacctcgggaaccttcccgatcgccttctcctcgtcccgcacagcccgcgcctgcttgaatttctcctgcatcgtcggattcttgtatgtcaagcggcgcaccgtcacctcctgcaccttcttgttcgcgatcctcaggttgtcttcggaaccgagcaatgccttcttcgtcttctgcaggtggtcgatcgacttgtcgatctcgtcgatcacggtctggaacttcttcgaggcgagctcgtaattgcgttcgaatccgcttttgaattcgttgagcttgtcttcgaagttcgtgatgtcgatgttctgggcgcgcatttcggccagttcgcgcctgtattccaaggtgccgcgtgccgcgttgcgcaacagcgtgatcatctggatgaagtattgggggcgaatcacgtacatcttcgggtagcggtacgagacgtcgacgatcccctggttgtacaggtcgctgtcctcttcgagcatcgacacgagcaccgcatattcgcagcccttctcgcgcctgtctttgtcgagctccttgaagaagtcctcgttcctgtgcttcgtggcggtcgtctcgttctcgttcttcatctcgaacatgatcgagatgaactcggtgcgaccctcgtcatcctccggtccgtcgtaatcacggaagatgaaatcgcccttgctgccggttcgcgcatcgttgtccttttcgaagtatgcgttcgggaacgaacccatgcgcactttgttgaattcgtcctgacagtgccgttccagcgattcgcccaccatcttcgtggagagccgcgttttgaaatcgcgcagacgctcgatctcgtcttcccggtcacgcagctgcacctcgtattgctcccgcaccgacttgagctcgagttcctgctgcatcttcgccgtgctgagttcaccacgcagccggtcgcactcacgttcgaccttgcccacctgctcggcgatctcgagctgcttcgaggtctgcacattgtcgagttgcgactgcagctgttggatccgcacgtccttctcggccgccgctttcgccttctcggcctccaaattcgccttggccagctcccgctccgattcggcatccgatttcagccgttccacctcgtggcggagctcgtcgcgttccttctccacatcgcccaccgcttcggacaccgcgagtttctgacggtcttcgaatgccgccagctgtgctttgagttcactaatctcggcgtccttgctcgccttcgcctgctgcagctcgctgttcgccttctgccgtgcgagctcaaccgccttcgccttgtcgtcttcggccagcttcaggcgtgattcgagttcgcggtcgaattcctgcccccgcacctgctgcacgatgtcggcgtagcccgcctcgtcgatggtgaacgattccccgcaatgcgggcacttgatctcatggcttgccatggctccctttccgtgcatcgatatgtattccatgatattccacgaacatgcgcccgccatatattgcgcatatgcatgcgcatgcgacgattcaccgcagcacggcgcgtatgcgcctggtcgcgcaagccgttcgtcgcgtattcgcggtgccccttacgcgacccatacgtctggcagatcgggtcgtcgtaattgcaatagctctgtgtacgcgaggcatatcggtcgagctcgtgcgggccgcgggctcccatcacgccgttcgtgcctttggtgaaatcgccgacgtcatacgatgtctcgctgttgaagcgtgggtcgccgaacaattccgctacgatgacattctccgaggcccggtcactaagcgtatacccgttgtcttcgttcggccgcacatcgggcgcgctcagcgcgtcccccaccaccatcgctccctgcgagtacccgagcagcacggtgtgctgcgccgggcactgctcggcctgcccattgagggtgctcatgagcagattcacgccgtccgcctgcgttccgggctccacgcttgccgcatactccagtggtgtcacttgaatgtgacccggggacgcacttgcgatctgctgcgcgagcggccccagcatgccgccgttgagttgctcgttcgtaccacgcacggtgatcacgcgcaccggcttgttcgcgtcgcatccggagtcgccccacgccccggaccgcccgggctctcatggcccggaccgttgaagagaatgccggcgaacaccgaacgcgtggtctgcggatccgagttgccgtccagttggcgaatctgttcgatcagatcggcggaaagcaacgagtccgtgccgcgcgtgcgttcctgagcagtctgcgagggtgtgggcgagggagcgacctgcgatctgccttccgcagcgcgctcgtcatgcctcgcaccgcacgcccccagcgccacgcacaacgtcaacgcacccacggcagccaacagtgatctgcaccgtgttccgatcgttcgagacaccatacccactccatattgagattgccagcatattcgagtcgtatcgaacatactggcaattcgaggtgtcactgtcaagcgacggctgtggaatgccatagcgaacgccagcattcgcaatcatctggggaggagctcatgccagaccgatcaccgaagtgagcagtctttgcacactgtcgatcctacgagcccgtttcgcgctgatccggggcagcacggcaagcacggcacgcgtcttgttcgcgcgcatgcggcagaaatctgcgagcatgctctcattcagcgtcccctgctggcgtgccgtgcgcaacgacttcgtctccgccgggcggaacagattgctctgtgaaagcgcttcgtatgcgagatcgactcccagtgcgcgaatgtactcggcttcgagatcgacgtgtgagacaaacacaagcttggattcaagttcgccggcccgtacatggtactggtgtgcgagatcgccctgggcatcctcgtcaacgagttgcgtgagcggcacgcggaagccgtgttcgccgaacacacgctgccatgcgggcatctcacggcaaccgcctgcttcgagcagcacgacgccgtgggcatcgagattacgcccggtcacattggcgcaatgttcgacgagcgcgcgatccgtcacgccttccaccacgatcacatgctcggcggtgagcggttcgagccggtcgcgcacccacatatgcagaagcagcttgtcgtcttcgctcaggaaatcgcgacggggttggaccacgccgccgttcgcgcgcacgacgacgatctggtcgggctcgaattcgcctatgatgtcgggcgagtgcgtggcgaggatcttctggctcgccccctccttgagcaatcgcgccagatttcgctggctcgtcggatgcagatgcgtttcgggctcatcgacaccgacgatatgcacgtgctcgtcgagcagatcatacaaggcaacggtgtagatcgaccgcaagcctcccgattgctcccataggccacgctgcttgccgtgcatgcgcaattgcaggtgcacgtcgctgaacggattgcggttgagtttggaacccggcacgaacatgagattgttcggattgcaacgcatcgggagcgccgacgtgagcgcgtcggcgatgcgtttgcgcaatgcgagaagggccggcgaggagtgcaacaggcgcgcgtactggtctgcgaccgcctcgaaaacggcttcctcctgctcaagttgcacggtttcgagcagttcgtcgacaatctcatgctgggtctcacggttcgacgggaaggaatcggaaaggtacacccagccgattcgcgccagatcggccgcggtcacgacgtgtccatcgtctcccattgtgcgcgagatgtgcacggtctcgccatcggcatcaagcgcggcctcgaagcgcatgcaagtgtgcatgccgtcgttctccagctcgacggcaatggtgaacggcagttgcggctcgcgaatatccgccgcagtgaccgtggcatacaggtcggcggtcgacttgcccaacacaagatcgaggcaccgcagaatggaggatttgccggattcattcgtacccaccagcacgagatgccggcggacgtcgattcggaaatcggtgacgcggctgtggttcgcaatgctcagcgaggtcagtctcatgggccaccgattccttgaaatcatgtcattgcgccgcagcgggtgcatgcggtgcatgcgcggccacgaaccgcaggaattcaggggtcttcgaccagtaggtgacgccccagccgtcgaagctgcgttcgcgtgtgtaggcggtgcattcgaagtctatatagtacaccagcccgttttccaccacgaaattcgtcgggaagtaatcgatgttcagacggtgggattgcaggcgcttggccatctcgcgcacctggtccacgtaggagtcgtccatctggtcggtgagcaccagattgtagaccgtggggccgtcgatgtattccttgagaatgcgctccttggcgatgtcgatgtcaagcatcgccggcaaccgtatgccgagctcgcacagtcggcggtaatcgcggatctccgcctgcactttgtcgttgggctgaaggaatggcatgggttcatggtgcatttgtttgagcacgtattcggttttcgaatgcgattgagaacgaacgaggaaggagtagcctcccttccctttcccaagcagccgtagcacctcaaagggctcgccattcacgctcagcgtcttatttggttgcattgttccagcataacatgcacattgtgaattctatgatgccccgcaatcatccaccgcgtgaccacatggcgccctcagttcttcctagccacccgtcgtcgacctattccccgttgtgcgcgccgaacgggatgtgcaccgagggtatggagagcgtgtaccggtcgagattgcccatctggtcgtcgaagaagatgtcgggctgcatgcggttgaggaagggcgccttgttcaggcctccgaggaagaacgcgtcgtcgaccgtcaacccccagtcctccaacgtgttcacggctcgtttctgcgcctttccgctccgcgctgtcacgagcgcgacgcgcaggttcggggtctgggccgccggattggcctccctgtattcacgtgccgcattctgcagtatgttgatgccctcaagcaaccgtttgagcggcccctcctcgatcggcctgttcgccaggtcagcctcatgctcgttgtatttctcaagcgcattggctgggtcgctcacctgggcctcacggaacacgcgctccgccgagtcgcccgcgagcacgccatcgaagtcgaaggctacacgcagctcctcgcccgactcgtgcacatgcgtcgcctccgccgcggtcccatcgccacggtttccggaatcactgagcggcagcacgcagccggctgggaatccctcggccacggcctcccgcacatccgcatcatcagccgagaggaacagcgccatgtcgaacgccttcatatactcgaagggcgagatgccgctgcggaacaccgaacgagtgatgtcgagcccataatgctcgatgctgttcatcacacgcaacccggtgcgcggactgttgcgcgacagcaccaccacctccacaccctggtcatcgccgtcgaagaccgaattgaactcaagcaatttcgaaatgaaggggaacgcgacaccaggacggaacggttcgtccaaatgctcgttctgatatcgttcgtaggcttcaacaccctcctcgcggaagatctggtcgctctcacccaggtcgaacaatgcgctcgacgcgacgcctattaccaatgccttgttatcgagcgtctgccccatatcgcctcccgttcgtccgattcaatcattgtaatgcaccgccgggcggccgcaccggcattccccgccgcgacgcgtactggactcagcacagcccgaatttggctatcatatgatagtcgctcatccactcataaggagaccccatgcaagccgattccgcaatgatgaccctgctcacatggtgcccattgctcgttggcgtcacattcttcgcgctcaccatggcattcaaccgccgttcgttgtggtccgggttctccgccttcgtcatgctgcttggcatcggggccacctcgatcgtattgctcatgacggcatctcagtatgtcaccggttccctgctcggcaccttggcgctcatcgccatctccctcgtcgccgtggcattgctgctgtttccgttcgcccttggcatcttcctcatcgccgaaggcattcgactcctgcgacgcgagggcctctcccccgccaattgcctgtcgctggcgctgggcgtgcttatttgctccgacctgttggtatttccggccatcgtcgcgagcgtgcacaacgacgccgtcaactgggtgttcggcgtgctttccgcatgcacgttctacttctccgcccagctcgccatctactgcctctcctccgcgctcaatctcatccatttcggcaaagcgaggaacatcgcacagattctcgtgctcggctccgggctcttcggcgagacggtgccccctctgctgcaaaaacgcatcgccaagggaatcgaaatccaacggcaggatccgcacgcgcggctcatcctctccggtggccagggcgcaggcgaagacgttcccgaaggcgtggcaatgaaggcatgggcgctcgctcacggcgcagatccggcaaacaccgtctgcgaggagcgctcacgcaacacccgcgagaatctgctgttctcacggaatctgttcgccgatccaaacgggaagacggccattgtctccaccggctaccatgtgttccgcgcactgttgctgtcgaagcaactgcatatgaacgccgtcggctatggttcgaagactccttggtatttctcgctgaacgcgttgctgcgcgagttcatcgcctatgtttcgatgacgcgcaaatggcagattgtcatactggtcgtcctgctcacgccgttctgggtcagcggcgtcgccggactcgtgcaggcgatccagcatctcgcgtaacacatctcgacaactactctggcgtaaatagagacacaaccaggcacccagacatcccctgttacacagaataatcccccttgcgtaaaaagagaccgaaccccgcttttatacgtccccttttacacggaataatcgcccctgctcttctcttacgtaaaaagggacgaaatagctgcttcagatgtccctttttacgcagaaccaaggtgtacaaggtatacaggaataccgcaacccaaacagatgaccagacattcaacactttggcagtgtaagtgtcgaattcgaagttaagtgacaaaagtgtgttcgggctgtggcggtgatctggtgtttttcttcggcgtgttgttactgggttggtaccggataatgaaaaagccttggaatcgttgaaattccaaggcttttactttgtaccccctgagagagtcgaactctcgttgtcagattgaaagtctggtgtcctaaccgttagacgaagggggctttcgacaactcgattaatagtacacgaatccattcatagcgcaaattcggcgtgtcggccttgcatggcgccccgcagccccgaaagtcggcgggacgcacgagcaatcagacacctcacacggcacggtatgcgaaatcgtggatcacgcgccccgcggccagtcccttcttttcgaaattcgtaagcacacggccatcgaaacgctccgactccatgaaatcggcatggggaagcgcagcggccgactcggcattgcccttgcccacatgctcgacaggcaggctcaccgtcagcgtgccgagattctcgaaatcccgccgtgcatccatcacctcatgcacatgcaacgcatagtcctcgatgtcggtggcgatgcgccacaccccgtcgacgccaagcgacgcatgcacgtcacgcgcaagctcgggctgcacgatcctgcgcttgtgatgccgcatcttcggccatgggtcaggaaagaacgtccacacctcgtcaagcacaccgggctccatcaccgcgaacaactcaggcgcgttgatctgcgccacccgcagattccgcaatccacgcttgcccgccagcagcacggtgtgcgcgacaccagggtcatacacctcgagcgccaggaaattgcgctcgggatgctccgcggccgcggccaccacattctcgccctgaccactgccgatctccacggtcagcggattgtcgttcccccactgcccttgcacatagtcccgggagaacacgaacccttcgcacgggtcgagactcccctccgacagcgcgatatcggagaggatgtactcatcggcatagttgtcgagcgcccgttgcaaccgcgcatcgagccgcgcggaacgccgcacgaacgaaagaaccttgcgaccgtgaagcggattgttcgccgcaccgccgttgccggattcctccagattcctgttttgctcagtcatacggctcagtctaccccgacacagccgagaaatggccagcgagcgcacgcccaggcaaaaccgcccaccgctccaccgcactccatcgcgcgcgaatatcgccataatgcgttacgccgggcgacattcgtcaggagggcctctagactggaaggcggcgggcgctgcctttccgcgacagtcgaacagaaaccggcatgctcgccaggcgacacaccgacgacggatttgtgttcgatagtgttcgagtgttacactataaacgcacatatatgaacattgcggatacatttctaccattcctatgttcataccagctgtaaggaaaggcttaacatgactgttcttgtcacaggcggctgcggctacatcggcgcgcacgtcgtccatgcactgcacgaagccggcgaagacgtcgtcgtagtcgacgacctgagctacggcaagcccaatcgcatcggcaacgcacgcctctacggcatggacatcgcgacaccgggagccggcgaacgtctcgccgagatcatggaggccgagaatgtggactccgtcatccacttcgcagcccgcaagcaggtcggcgaatccgtggagaagccgctgtggtactaccagcagaacatcaacggcatgctcaatgtgctcgaaggcatgaaggaggccggcgtgaagaagctcgtcttctcctcatccgccgcaacctacggcgtgccgccggtcgatgtggtgcccgaagacgtcgaaccgatggttccgatcaacccatacggccagaccaagctgttcggcgaatggatggcgcgtgcctgtgagcagccgtacggcattcggttctgcggactgcgctacttcaatgtcgccggctgcggccccgtccagctcgaagacccggccatcctgaacctcatcccaatgctcttcgaccgtctcaagcagggcaaggcaccggcgatcttcggcgacgactacccgactccggacggcacctgcgtgcgcgactacattcacgtctccgatctcgccgacgcgcacatcgccgcattgaagtatcttgaccgtgacgagcgcaagtacgatgtgttcaatgtgggcactggcgagggcacctcggtgcgtcagatcgtggacgaggtgaagaaggtcaccggcctgccgttcaaggagaccgtcatgggccgtcgtgccggcgatccgccgcatctgatcggctcccccgagcgcatcaacaccgagatgggctggcatgccaagtacgacgtcgaagacatcgtcgaatccgcatggaacgcatggcaggcgaacccggatcaccacatcgacgtggagacctggaagcagaccgactgacgcattccatcctgcacgcgaaagggctccgttccatcagaaacggagccctttccatagatcgtacagaccatgctgcgcaatgaacgcttatgcccctacctcgtcgcgtcctgcgcctcgagctgcttctccacatagtcgactatgtatggggcgacttcctcgatctggtcgatggcgatctcgaagtcacgctggcccccataccatgggtcgacgagatcgatgtcgctttcacgtcccggctgcgggtctggcaggttcgggtcgaaactgcgatacataaacacatgcgaacgcttgctcaacggcagcatatgcatgagcgcgcccatatgcgaggcagtcatgggcaggaacaggttcgtctcggcgatctcgttcggggtgatgcgatgcgcgaaatgctccggcggaatgtcgtacccatgctcacgcagcactttcacggcacggcgatcaatcgggttgccgtgctcctcgctgctcacaccgctggattccacgcgcgcccgatcgccaagcccacgctcctcgaattcgtgacgcagaataatctcagccatcggagatctgcagatgttgccggtgcacacggtcatcaccgtgtacggctgcggtttcgtgcccattcgtctctctcctctcacatgtgttctggtggtgttattcctcttcggcctgttcgtcgccggtattgcgttcgaacgtcaggtaacggtaacgatcgatgccttcgggcttcttcggcgtgagccatcccgaattctccatgagtttccaggaaccgttgttgagcgcctcggtgaggtctggagcgtaggcgtccgcattcaccttggcgtcgacctgcgtcatgtagatcttggatgccattggcaacatctggttgaacagctgggagccgccgatgacccagatctcgctgcggtcgagtccgtcgtcgggaatggcctcctgacgggccatatcgagcgcctcctccagattgtccaccacggtggcacccggcgcacggaaatcacggtcacgcgacaacacgatgttgtcacggttcggaagcggccggaacttctcgttgagcgcctcccaggtcttgcgccccatgatcaccggatgggagacggtgagctccttgaatcgcttcaggtcttcaggcagatgccagggcatctcaccctcatacccaatggcaccggaacggccttccttgtcgtttgcctgtgcccatatgagattcaccgagaacgtcttggggaaatcatctccccagtcatcctcgaagacttctggcccggcggatccgggcacgggttcgtgatagccactgcggctacttccagactccatttctcactccttggaacaagtctcaaacgtaaatcgagtctataggcgagtcacgacctgcagcttcgttttcgcgggttttcaccgcaattccatatgttggccgatcgaatcgaccgtgaccctcacaccgcgatcggagccttgatggtggggtggtatcgatagtccgcgatatggaaattggaatactggtagtcgaacagagaatcggccttgcgaatctccatcctcgggtatgggtagggttcgcgcgagagctgctcaagcacctgctccacgtgattgtcgtagatgtggcagtcgccgccggtccacacgaattcaccgggttccaagccggcctgctgtgccatcatcatcgtgagcagcgaatagctggcgatgttgaacggcacgccgaggaacatgtcacacgaacgctggtacagctggcagctgagtctgccatcggccacatagaactggaacagcgcgtggcacggcggcaacgccatgttctccacctcggccgggttccacgcggtgaccaccatgcgccgcgaatccgggttgtgtttgatgagctcaagcacattggagatctggtcgattgtgcggtcgggatcgtctgcggtgggagcaggccaactgcgccactgcacaccgtacaccggaccaagatcaccgttctcgtcggcccactcgtcccagatgtgcacattgtgctcctgcagccagtgcacattgctcgagcccttcaagaaccacagcagttcataggcgatgcccttgaagaacacgcgcttcgtggtgagcagcgggaaccccttcgccagatcgaaacgcatctgctggccgaacagcgagatcgtgcctgtgccggtgcggtcgttcttgagattgccttccatgagaatcttgcgcagcaggtcctcatacggcatcgggatgtcggtgtcggggcgcggcggaatctgggtgcgaatagcttgcagttgctcctgaatcaatggcatggcatgcaatcgtaatcgcaaagtctgacgagacgatgccgggagcgaatacagcccgacacggcgggcatatacccgcctacaatgtggttgagtaaacgagacgacacatccgcgtggaaagaaggcacgtatgagcaagcgaatttgggtcgagcgcaacaaggacggctcgtgggacgcattctccgatgacggcgcccacatcaagttcggcaagggccgcggccagttcacgcccggcgatctcatgaagatcgcattggcgggctgcgcggcgctgtccagcaacttcgccatcgaaagcacgctcggcgagggcaagggcgccaagatcgtcgtcgacggcacctatgacgccgacaacgactcgtacatcaacttcaacgagaccctcatgatcgacgccaccgacgcggacctctccccggaggacgtcgagaagctcaagaagcgtgtgcgcgctcacgtcgacaagggatgcaccgtcaagcacacctacgaacaggttacaccggtgcgcatggacatcgaggtgcgcagctgaccgaacgcggcgcaaagggagagccgccgtgggcaatatatcgattgcattgcccgcggcggcttttcgttatcgggagaccacccgactactgttcgttatcgtcctgccggtactcgtgcgccttcgggtcgatgtcgatctcgatctggcgttcggtttcctcgctggcgcgctcaaccggtacctcgcgcacgaattcctcgagcgacgtcacttcggcggtctcggttcccgatgcggtgcccgtcttcacacgctgttcctcagcctccacgaacttgcgcggcaccacgtagaccggcgacgccgaatgctggagcaacccctggctggtggagttgaacagcagaccggtgaggccgccacggccgcaggaaccgaccaccacgatgtcgtgcgtatgactggccttggtgagcgtctccactgcgcggccggccacaatcgatttgcggatcttgaggtcggggtgtgtcgtgcagatggattccagacgcgcgtcgagcacatcttcgaacttctgcttctgtgccgggtcgtcgagattggtgttgcccggcaccacggtgatcacgtccagctcggcgccccagttcgcggcgaaatccgcggcgatctgcagtgcgcgcaggccccacttcgtgtcatcggacccaacggctaccttggtgatcacattgttgagatgcagcagattgtctttgtcgtcggtgtacggcacgacgacgatcgggcagtatgcgtatgccggcagactcgagctcgtcgtgccgagcagacgctccgccagtcctcccttgccgcggttgccaatgacgatcagattgtagttgcgcgacagttcgacgaacaccgacgacggatcgcccgtcacgatgagcgtctgcgcgttcacgccctgctcatcggcgattgccttggccttcgacagaatctcctgggcatcgttgtgcgcggcgttgtcgtcgcccatcgacgtgtatgtggcgtcgaacgagacggcggcatagctcggcaacgagtatgcgcagacgatctgcaaggacagtcccatgtgcttggcatagttcgcggcccaccatgtcgccttgtagctcgcgtgcgaaccgtcgactccgacgaggattgtgttgtcgttcatatgagggacctccttgaccagcaatgaaacaagtactggtatctagaataccgtgccgacgcatgcgcgcgcgtttcggcggtgaaatccgcacaaatcgatacgcctgccgatatgccatgcgcccgcagatcgcccaataccgggtcgccatccgccagccccgcatactcctgtgtagaaggggctcttccctttaagcatgtaagagccgtaaaaggagacaaataaccccctggcattgactccttttacgtcagggaccatcgctccatgcgtgatccgtgcaggctctgtgcgcgatctgtgcgcgatctgtgcgcgacctcttgcgtaaaaggggacagcgccggccatctcaccgactctttttacgcagctcgctgccctctttattcatttactcagcaggtgctgcggcatggacggcggaatgcgaagggccgcgcacccgagaacggatgcgcggcccttcaccgtatatcaagagaggtcacagaactcgacggatgctgtaggcagcaccaccgaatgccgagagattggtgacctgcgtaccctgcgccgggttcaacgcgttgacgatcatgccattgccaatatagatggcagcatggttggcattcgcgatgatgtcgcccggctgggcctcggcgaggctcggaacggcggttccgacaccggcctgggcgcccgaggtgcgcggcagattaatgccgaaccgggagaagacatacatgacgaatccagagcaatcccagccgctcggagtggtgccacccgatacatagggggcgccgatgaacttctgggcataggcggcgatggctgcaccgttcttgctggtgggcacggatggggcagctgctggctgcgcggccggagcggcttcctgctgggcggtgttggcattggtgtcggtgagggattcacgcgcctggccgcggcttgcggccgcggcctgctcacgtgccgcctttgcggcggcctcttcctgtgcacgctgctcagcgccttccttctcggcttgggcgcgggcttccgcttccttctctgccgtggatttggtctgtggaacatccattgaacccagaccgccccagttggagtccttgtcgacttccgtggaggtcgcctcggcgaagaagttcgccttggccacgttcaccttcgggaacgaacgggtcgatacgacgtagttcgagcccgactgggagtcggcggcggttgcggccggcgcgatgctggtgaacgcaagcgaggctgcaactacagcggtggcaatcgaaatagaacgcttcatagtattcatcgtcgtccacagtagcacagccaacgtgagacgattgtggaaacctacaagaaaatggttggaatactgggagacacgccgagaccacaatcgactggcagtgtgctatattatgaagttttcttcacatatcgcccggagcggacatatcttgtctagcataccctgaatctggaatatacctatcctcgcaacagattgccactgagccaatccgcgctcgtgcccatcgtgaaggcgaatgcgctccacaggtttcgtcatcgagtcgctcgttcacgcgctccggacgaaactgatgccctagtttcgtcatgaagccgctatctggcatcgatacgacgaaacgcggccctgtgtttcgtcatatcaacgctcagccgcgaagaaataacgaaacagcacggttacccataacactgcgtttgcaagaaggcaagcgaaccgggaacacgtcgcactcagaagtggatgtactggaaattcctggcctgtgccgaggtgaaggtgcgatgcgagatcacgccgacgccctgcacattggattcggagatctcaatggatccgtcgggattcaccttctccaccacagcgacgtggccgtagacccccgaggcaccttcctgacccggtgagaacacgagcgcgtcgccggtattgcgtggcgtgttgtcgacccaatagcccatggaacctgcggatacggcccaggagcccgcattgccgaagtgcgagccggtgttgagaccgagttgcgcacgacgctcgtacgcccaccacgtgcactggccgtaggggtatgcattgccgcgatcaccggtttcatgattggcatcgaagccctgcggcagctgaccctgatgctcgtccatgaggtcggcgaccttcgggttgttggcgagtgcgcgggaaagcgcgttcgaatcggcgatcgagttgtcgccgccgagcccccacttgcctgcattggtggtggagacggtcttgccgttgtcgatggtgacgttcaccttggcggacgacgagctgacctcggaggtcgcggtagccgtctcgctgcttgcggtggcgctgtccagagcctcacgcgtatcggagcgcgaagcggaaccgtcggcgatgcgatgcacttgcgtggtctcggtcgggtcctcggccgccagcactgtggagccctcgcccttcatgaaggccatcgacgtcgccgcggttcccaccaatgtcgccaatgagacggaggtgagaatgttgtgcttgcgctgggccgccttggcggtctgacgaatcgccttacgggtcaaaggtgcgacttcgttgagcttggctgccagatcctcgtcgattgccagcgcctgcgcgtcacctgccgccgcctgcttcgcccgcacgccctgtgcggaatgcgagcccgtacgcgatgcgaacagagagttcgttaggctttttgcacctaaccccttgtgggctttcggggctgcatgcctcatacaaaaaactccttcggtcatttcagcctgcacgctctgtcgtgctcgttatgcaactttcgacaggatacctcacctaaccgtcaaaatacagctcacattcgcgctttcggcatcgaacacgccgggcacacagcggtacgcccctcgcttacgcctgtaatttcaaggttccacaaaatctcgtaaatttcttgtcgcaccttcacaatccacgcattcttcgtcgtgagccgggtgcctacacactcacccggtgggtgtccagcgtccaagcaatgcaacgccgttcgtccattcacctgcgcgacgcatgccttcctataatctaaagacatgagcactattaccattccgcaaaacatgcttcccgcagacggccgcttcggctcgggccccaccaagatccgtcgtgaacagattctcgacctcaccaatgccgcagacacgctgctgggcacctcccaccgccagcgtccggtgaaacagctcgtcgaatcgatccgtgaagggctcgccgagttcttctcgctccccgcaggctacgaggtggtgctcggcaacggtggcgcgagcgcattctgggatgtcgtatgctgctcgctcgtcagccgcaaggccgcatgtggcgtgtacggctcgttcacgaagaagatggccgcctcactctcctcggctccgttcctcgaggaaccggccatatatgagggtgacttcggcacttggcgcctgcctgaactcaccgatggcgtcgacgcatactgctgggcgcagaacgagacctccaccggcgtcgccgcaccggtcaagcgcatcgccggcagtgtgaaccaaggcgcgctgacgatcatcgatgcgacgagcggcgccggagcgctgccggtggacctgtcgcagaccgacgcctattatttctccccgcagaaggcattcggatccgagggcggcctgtgggtggcgattctctcccccgaggccatcgaacgtgccgaggcggtcaaggagaacgctgccgttcccggttcgatccgctggattccgccgttcctctcgctcacctccgcgatttcgaattcccgcaagaaccagacgctcaacacgccggcgatctccacgctcgtgctcatggagagccagattcgctatctcaacggcaacggcggtctcgactgggccgtcaagcgatgcgagcgctctgcgaacaccgtgtattcctgggccgaggcgagccgctatgcgagcccgtacgttgtggatgaggaggcccgctcgcatgccgtggtcaccgtcgacctcattgacgcggtgccggccgccgcagtgctcgaggcgttgcgtgacaacggcattgtcgatgtgaacggatatcgcgcgctgggacgcaatcagctgcgcatcggagtcttcccctcggtcgatccgtcggacgtcgaggcgctcacgcactgcattgactatgtgattgaacatctgtaatccatgcggcatgggaacaccgcccatattgctgcgtcgcttatgagatgcgacgtgcataacgcggaaatgttcggtatgctcaacacataagcccgggtcacacatcccttccgtgacccgggctttttctgtgccgatatgcgcattccgcgctcagtcgatgtcggtgccttcgtctcgcgacggcgtcttcgtggggtcgaagccggagacgatgaacacgacgcggcgtgcggcggagactgcatggtcgccgagacgctccatgaagcgtgcgatgagcaccacgttgatgagctgctcgttcgtgccctcccattcggcgctgtcggcgtactgcatgatcttgagatgcagatcgtcgagctggtcgtcgtcgcgaatgatctgctccgctatcgcggtgtcgcggtcggcgagcatgtcgacaaggcgaccgcccgtgatgtcgaggaactgctgcattttcgcgaacgtgggcaccagattctgcggaaccggcgagttcgggtaggtgcggcgcgcggattccgcgatatggcgcgccagatcgcccatgcgttcgaaggtggtggccaggcgcatcgtggagacgatgacgcgcaggtcggtggccaccggattctggcgtgccagcagctccacgcattggtccatgatgcgggtggaaaggtcgtcgatgctcgcatcgttgtcgatcacggtctgggccgcatcgagatcctgatgaagcagggcctcccccgccagacggatggcgtcgcgcacatcgcgggccatatggtcgaggtcgtcggccaccgctttgaggccttcattgaaaatcacgcgcatgtgttcaccctccctgttgctgcccgtgcgctatgtacgcaatcattgtagccgatgcgacactctggcgtgtgccctgatgggcgacgtctcatgcgtgtgttcgccatctgcgacgggaaaatgcgcatctgctgcgcaccgcgcacgaatatgggagaatgatgccatgccacaattcacaaccacggtgatcgccgtcgcgttcatactgctcgcggtcggcgcggtcataggcctgttggtgctgctctacgactggctggccccgctcatctcccgcactacacacggcgtctcgcttcccgattccatcggcgacctcgtctccagactccggcgccgacgctcgcgtgacgatgaggacggcgacgacgatgacgatgacgagcttgacgatgaggccgccgcgttgttgtcgatccttccggccgcatcgattgtggtcgacgattccgacgacgtggtgcgcgccaatccggcggcctaccgtctgggcatcgtcaacgacgacgtgatcgtggattcgcgcgtgctcgacgccgtgcgcaaagtacgcgagcacggcggcaagacgtcgctggagatcaccacctccacaccgaaacgtttcgcgttgcccgaaccggtggatactgaggaggacctgaaaaccagcaccgtctcgcgccccaactggctcaaactggtcatcgggcgcatcgacgagcaattcgtcgtcgtgctcatcgacgacatctcggaatcggtgcggttctcgcagatgcgcgacgacttcgtgacgaacgtgagcgagatgatcattcggccgagtgaggatctgcaacggctggccgacgtgctcgaacacggcggcatgagccccgaacaggtcgcgcaggcggcccgcgacgtgcgtcggtcaagcgcctacgtcgatcacatggtcaagaatctgctgctgctcatcaaggcacagggcgatgctccgaacgcgcaatccgcggtgttggatgtgcgcgaacaagtggaggtggcggtcaacgaactcttgccgcaagcccgtcaacgcggcatcacggtgtccatcaccggcaagggcgagccgaaagtgcgcggcaacgccacggcgattcgtgcagcgatcggcaagctcgtcgacaacgccatcgaatactcgcccgacaacgcgaacgtgagcgtgctcatcgaaacgacgcgcgacaccaaggatgcgttggtgcgcgtggtggaccgcggaacgggaatcccgctcaaggagcagccgcgcatcttcgaacggttctaccgcggagcgaaccagaacgagcgcacgcagtcgggcgtcggcctcggcctggccatcgtcaagcatgtggccatcatgcaccacggcaatgtgcaggtgtggagcagacctgggcagggcagcacattcagtctggtgctaccgctcgtgcccgagtctgcagaggaggccggcgaaatcagtcggcgccgagccgacggtaatcgcgacggtgaaaatgctcccacacaagcaatgcgaaaccaatcaacacgccatacgagcagatgaacatcgactggcgcgacatctccgaatgtgcggtggagaagacgacaatgctcacgatcagcgcgacgacccagcagcagatgcctatgatgaacgccttgcgtagatcgacctgcaccggtttggggctgggacggcgctgggtcgggtcatagatcggagcgattttcatatggcccactgtaatcacaggtgtgtagcagtggaaataaccagccaatcgagccctgaatgtgggaaaaatcttcccatgtgggcacaagcatgcgaattcgcgtacaatatgcacgtatgcgcgagcgccgaaaaacgccaagtcagaagggagcaggcagtgtacgctattcgccctgttcccaaacactatgcctggggctcgcaccgaacactgcagcatgtgttccatttggatgaacacgaaacacagcagccgcttgccgagatgtggttcagcgggcatgcccagtcgccgtcgccgataatggtggatggcgtcgaacagccgctcacgtcgatgatcgagcgcaatcccattgacatggtgggtcggcgcggctcggaggaattcggcccggtgctcccctatctgttcaaactgatctgcgccaccgaaccgctctcgctgcaggtgcacccggtggcctttcaggcgcgcgcggggttcaacgaggagaaccgcgcaggcataccactcaacgctcccgaacgttcgttcaaagacatcaatgcgaaaagcgagatggtggtggcactcgaaccattcctcgcggcagtgggattctccacgcgcacattcgcgctacggaatctggaattgctcaggctgccggtggcgcaacgcatggtggaggcgctcaactcgaccgccacgcagtcggcaggcgaatcatttgtcatggcggacgagatgatgcccatcgcctccgccgtatggtcaccggcgagaaaacgactgttccgcgcattccatgcggcgatcacggcgcaggaaacggatccgcaggaactcctcgacgatctgcagcatgcgcgctcactcaccgaacacacgcgcaacgatctcgcattcgacttcgcgattcgcgcggccaaggcgttcccgggagacacgagctcgctcgcactgctcatgatgaacccggtgaggcttgaggagggccagtcggtgttcctgcccaccggcaccccacacgcctatatatatggtacggcagcagagatcatgacgaattcggacaacgtgctgcgcgcaggactcaccgtgaagcacaaagacatcgtgaatctgctgcaatgcctggactgccgcaccagcacgccggtggatccgtcgaactcgcagatcgccacgatgctgatgcgcgacctcgccttctacaaaccgaacgtgagcgagtacatgctcgcctacgggcaggtggatgtgcagcatgagccctggccggtgatcaacgcgctggccaaacgctacgactcactggtgaggcagatcagcgggcatacgccgttcccgcattccggccctcgtgtggtggtgtgcacacaagggtcggtgcaggtgatcagcgaagcggattcacgcgtactgcatcagggagacgccgtgttcgtgccggcgagcgacggatgggcgcatgtcgaggccgtgatcgacggcgaaggcgagcctcagggcaagtatttggtggcctccacgccgttctaggcgacggcggctgcgtgggcggcggtatttcggacggatgcttccgaaaaccgtgccgcagataggccctctcgcggcacatctttcggaagcatccgtaaaacggggcacaaatgggaacccgcgcggcgcggtgttcggaaaactccatgcaccatgccgcgcgggccatgccaaaccgcggtggagccgctagatgtcgagcgaaacgaccagcttgccggtcactttgccggtggcgagcgtcttcaacccatccaccaactcggcgaacggcagaatcctctcgatgagcggatcgagacggccctgcgatgccatctcaaacacgtcggtggccattgtgcccaaatcgttctgctgccgagaatcgccggagccatgcgcaccgccgagattgacgaccgccatgctcagtccacggccgaacatgtcgtcactgtcgatgttcggcacgcccacaatggtgacgagctgaccgttgtaggccagtcggtcgaagtccttctcggcctccgcgccgctcaccgtgtccaccacgagatcgacgccgagcccgtcggtgagctcgcctatgcgttcggtcacatcctccttgcggtagtcgatgaccgcatccacatcgagatgtttgcgcacatagtccaccttggcggtggagcaggtggtgaacaccgtgaggccatgcatcttggcgagttggacggcaatgccgcccacggctccggagcctccatggatcaatgccgtgtgcacattgttgagattcggtttgcggttgatcgtctggtaggccgtcaacgcgctgcacagcaggccggcggcgtcggtatagctcacgtcatccgggatgcgggccagctcatacgtcggcgatgccacgtattcggcgaagcagccatcgtagcgcaggtcgccatgtgtccggcgacgcgcatgcccagatgccagtcctcggagacatccggcccgatggcggcgatttcaccggccacgtcaaggcccagcgtatgcgggaacgaccagtccgggtcaccgccctccgccagcttgtaatccaccggattcagaccaaccgcatgcaccttgacaagcacctgccccggtcccactgccggaatcggcacctcggcgagcttgatggcgtcaagaccatggtcgtccgcctgctcaatcacataggccttcatttcgccgaatcattctcccccggctcgagagcgccgtcgggcgcagccgccggggcgacggtgtccacggtgtccacggtgtcggcggcaaccggtgcatcggcggaacacggcgtcgcgaacgcctcggcctccgcctccttggcatgctgcatcagacgctgctcatccgcttcattgaacgactcgtcgaaccgcatgcccggcttcatatccaccgggtgcttcgggtcggcgatggcgccatacaccttgagcatgtcgtagatgtacgtgcccctggtgcgccccagcgcaaatgcaatcgccttgcgttccacattattgcgtccgaaggtggtgagcggctgtccatcgcgcagcttgacggccgcgttgagcatgtcacgcacgtcgtattcgctgttccacacctcaggcacgccacgatccacatcgcacaacgtgtacacggcctccatgccggtgcgcatcgaatattccgtggtgaagatcgtgtcacgtggctcctcggcgaactggccgatgaacgcgaagttgacggcaccgtccggcacgacgtcggggcggtcaccgagttcgcgcggcatgaagaacgcgtcgacatacggcatcatgaccggcaccgtgttgcaatggttcttcgcgagctcctcgatctgttcttcgggcactcccatgtggtagagccattcctcgcagatctccataccggtgcagtcctgcatcggcttgcgaatgtagttgcccggcttgtcggggaacaaaccgtagatccacgccgagatcatgtccttcggctggttgcggaactgctgctgccggttcacggtccagctcatcagccagttcgaatcctccacggtcacgatgccgccggtaacggtgtgaccgccgaacggcgagcgtccggtgatcttctcgatgtaggccggaatcgtgtcgtcaagcgtggtagcggtggcgctcatccacttggtgaggttcggatcgtaaatgaacttctccgggtggccgaagctcgggtcgacggcggcaatgcggttccacatgtcccagccgttgcccggcttgagcgtcggatcgaagccggccggcgtgttctggtcgccctcggtggtcgactccaccaagccgccgttggtgatgaacacgaaatcgtcctcggtgagttcgatcgtcttgcgctcgttcttcaccaggtcggtgattaccagcgtcttggcgaccttcttgttcggcgtgctgtacgggttgcgcgggaatgcgccgttctctgcttgggcgcgttgggcctcgtccatcgacacattggtgaacacattgcggaccgggccgttctcgtggtcgctgatggcgaaggtgacgtcgtcgacggcggtgcccatgtggaactgcacgtcgtgcgccttgaggtagttcatgagcggcaggatcatcgactcatactggttgtatcgcgtgaaccgcaatgccgagaagtcgggcaggccaccgatgtgatggatgaaccggtggatgtagcgatgcatctcgagcgcggaatcccagttctcgaaggcgaacatggtgcgccagtacagccagaaattcgaattgagcacttcgtcgtcgaagtagtcggtgatcttcttgttggcgagctcgtcctcggaggcgaggtagagcttgaggatctccatgcaccccttgtcggagagattgaacttgttgtcggtgtgcgcattgtggccacgtgccttggtggcgcggcacttcgaatagttcgggtcctccttgttgagccagtagtagtggtcgagcatcgacacattcgggtcttcgatgctcggcacatcgcggtagacgtcccacatgacctcgaaatgattgtccatttcgcggccaccgcgcatgacgtagccctcgcccttgatgaacgcgccatcgagcgcaccgccgggaaccacgtccttgtcgaacacgtggatgttcttgcccggcatctgcgcatcgcgcacgagatagaacgcagcggtgagcgccgccagtcccgtgccgatgatgtacgcgctcttgttctcgaggccttccggcttcttcgggtgtgcgaacgcttcgaaattgcctgccgaatagtacatggcacctcctcttgcgcgggctcgttcccgcgaagatttgcctgcgccgactttcggcgccctagtgtccattgtccgtctgttcgcgcaatctgagcacggggtttgctcttagcttggttttagcgattccgcaggcggtctgcaacgcactgcgaacatggtgcatgtgcatggccgtttttgcaatcctatgctcatccagacatgctcacaggattcagatggctgctcttgcaactgcaatctcatcctgacatgtttatgcaggtcaagaatgaccggatttgcaagcgtactctcaacacagtatgcgaagatcacttcgcgtgcctacacatgccccagattgcaaaggcggtcattaaattcgccgcagaaagatcgttcttgcagctgcgatctcagcatggcacagctagagccgtacgatgaccacttttgcagattcaatctcagcgcagctatctcgcatttcacagaatgggcatctttgcaactctggtctcgattcagcatgattatgcgaatcaaatagtcgcctttgcaatcatggccgcgcctagacacgcaaaaggcgacccggcgcgaaaaacaccgagtcgcctcatacgatcagacgagtggttatcggaggaccgccaagctcacttctggccctgggccgcaacagcggcggcaccggcggcagcggcctcaggatcgaggtattcgccacccttcttgatcggcttgaagttctcgtcgagctcatagaccagcggaatcgcggtcgggatgttcaccttggcgatctcctcttcggtcaggccgtcgagcatcttgacgatcgcacgcagcgaattgccgtgggcggcgatgagcacggtcttgccgctcttgagctccgggatgatctcggcttcccaatacggctcgacgcgggcgacgacgtcggcgaggcactcggcttccggaaccgggtcgccggcgtaacgcgggtcgttgttctgcgcgtactggtcgttcgggtcaatctcgggcggcggggtgccgtaggagcggcgccacagcatgaacttctcgtcgccgtactcctcgcggatctcggtcttgttcttgccctgcagagcaccgtagtgacgctcgttgaggcgccagtcgcgcttcacgggaatccacaggcggtcggcctcatcgagcgcgatgttcgcggtgttgatggcgcggcgcagcagcgaggtgaagacgatgtcgggcagcacacccttgtccttcatgagcttgccgccgttcttggcttcctcgcggcccttttcggtcagcgggacgtcaacccagccggtgaactgatttgtcttgttccattcgctctgaccatgtcggagcagtaccagtttgtaagtcatatgccctagtctagcgacccgtcgagtcaaatgcacgtgcattgccatatctgcccgattggcgggataatctgcgaacgcgacgatctcagcgcattcagatggacatggtgagaccgacgaacaccagcgcgacggcgagcgcgatccacgacagattccgcatggcgctacggtattcccgcttggccacattgaattcgacgaccacggtgagcagtatgagcgcgatttcgccgagcactgcgcagtaaccgccgagcacgctcagattgggcagatcggaatccatatggatccacatcacgctccacggaatcaccatggcgagcatgacgagggcgatgagcacgcacaggcacaccgtgaatgcgcgcgcgccgatgcgtacggcgagcgtgcgtttgccgctctcacgatccgtgttcacgtcgcgcagattattcaccgccatcacggccgccgagaccgcgccgatgacgaccgcaccatacacgccgttcccgttgacctgaccgcacagcacgaactgcgtgccaagcgcggcgaccgggccgaagaacacgaaggcggccagctcgccgaatccgaagtatccgtatggatgagagccacccacatagaaccatgcggctgtcacgcacaacgcccccacgaagacgagccaccagtagccggtgatcacgatcaccgcgagcccgcacacgcaggcgagcacagcattcacgatggccgccatgagcaccgcgcgcggagtgacgccgccggccaccagccgcgtcggcccgttcagctcgcgcgcctgccgctcctcttccgcggtcgcaccgttctcaaggaactgaaaatcagattccaccgtgtattgccgtaccgccgccgtacggtgggcatcggtgccgcgcacgccgtctgagtagtcgttggcgaaattgacggcgatctgcaggaagagtgcgacgagcaggcaaagcagaccgagcgtgatgattctgccagtgcccgcatcgcatgccgagctggcggtgaggatgccgcaggccggcaagccgtccgcaccgcgcatgccaatcacccggcacgccgcgctgacgccgatgagcacgggcgcgatgccgagcatgagcgtggggatgcgcatgccggaaacgtaatcgtgaaattgcatagtttgaatatatgcccgaatactcgaacgcgcgagcgcaccgcataatgggtgagctcgcgcgcgagttcgagcacagggcgacagatcaggccttcgaggactcgttcgacatggagtccgcggcagtctgctggtcgagcacgttctgggcgacctgcttggcatgggcatcggcctgtgcattgcgggcgatgcgttgcgccttggtctcgcccttggcacgggagtcggagagcagatccggcgtgtgatgtagcgccttcgtccacacgtagtagaagatgatgccgagcacgagccacacggtgcccacaatgagcacctcgccgccgagcgagcagaagatgacgccggtgacgattgcgccgatgagcgggaagatgatcgtacgccagaacttgccatgttcgaggattttcgccttgatgcccaggccccagatgacggcgatgttgagcatgaagtacgtggagagcgcgccgtagttggagatcttcgcgccggtggtcataccgatgggcagcacaatgaagatgagcgccagcgtgaggacggcgacgaagccggtggcgacggtggccacgcgggtcttcgggctgatcttggcgaagaccgacggcaatgcgtcgtccttggccatcacgcgcagcagcgaggcgccggcggtcatgcccgacagcgaggtgaaaatgccgagcgcgagcgcattggccacggcgcacagtacgccaagccactttccggcaaggccggccaccaagtagaaaccgttgttcggattggccgccatgagcttgccgctcggatccatgcacatcgtcagcaggctcatcgccatgtagagcgcgcccagaatgagcacgatcacgatcatcgcgcgcgacgggccatgcttggggtcgaggctctgatcgtcgagcgtgaccacggagccgaagccgacgaacgacagcgcgcacagcgagacggcgctcatcacagcgcccatctcgaagtggcccggattgtagaagccttcgaaggagaagtgggccacgctggggttcttcgccacatagataacgccgaagatgaagaacagcagcagcacgatgagctcggccaccaaggcgagcttgtccaccatgacggtggcgccggcgccacgcatcgcgatgaccgtgatgatggcgaggaagatgaggcaccatgcccacactggaacggccggcacgtattcatgaattgccaggccggccatgatgagcatgacggccggcgtgatcaagtactgcaacagcatgagccaaccgaccacgaatcccaccgggccattgatctcatcggaagcgtagacgaagatgctgccgctcgacgggtagcggggcaccatgaggtcgaacgagaacgcggtgaacagcatcgcgaccatggcgatcacgtatgcgagggccggcatgccgtgcgacgtgttcgcaaccgatgcgagaatggaaaacggggcaattggcaccatgaagatcatgccgaacaccacgaggtcgaataccgagagtgtgcgcttgacggtgaccggaccgcccgcacccgtattgtttggagctggggttccctgtgacttcgttgcagcggtcatgtgaggctccttcccttcctggaaaatctcttccgtactatttcaattttcgactatagttctgtcgtcctgcgttggaacggcactgtgcggtacgcaaaaatcccgaagggattgccctcctcttcaatgggaggcgggcaatcccctcgaatcagacccttagatcaactactgcggttccttggcgtcggacgcgccggacaaatcagtccttgtcttcatgtcgcttgtcgtagaaggcggcaagttcggggccggtcgcagccagagccacctcgtcgcagtacagcatgtggccgttggagtgcagatggtactcgatgcgatccttgagcgcctgcggcaggaacagcttgttgatgtcgtggcgcacgttccagtacggcgtcgctgcgtcgtggatgccgccgagcacgcagatgcggctcgtcgggttgcgacgcagcgcggtggcaaggtcgtaggccacattcggaacctgcggggaacccatggtgcctggagcctgatgcgtccagttccagctcgagttgaccttgagcgagaggccctcgtagttctcgtagcccttgaagcccatgtcgccgagcatcttcatgtacacgtcgaggtaggcggcgttgattgcgtcgtacgacggatcctcgccggcgaagaactcgttgtcgccctgcacgtcctggtatccgtacgtggtgaagcgggtgtcgtaacggccggtggtctcgccctcggccttgagcaggttcttgcggaacgtgtcgagttcgatgcgcaggcccttctcctcgataaagtcagcaggcagaccgatgaactcgctcatctcgccggcgatcttcttcatctcgtccgccggcaatgcatcggcgagcgtcagggcacgggcaagcgtgttgttcgcatagtcgaacgccttgtcgtaccactcatactggtcgacgcccaccccggccttcttgaagtagttggcggtggcggcgtacacggggaacatgcccatgtagtagtcgtcctcaccggagagcgtgggctcgtagtcgagaatggtggactgttcggtgatgcctgcgacgccgacgccatgctcgccgagcatgcggtagacgacggcgttgcgcatggtgccgtaggattcgccgtacaggtagtgcgggctgttcatgcggtcgtacttggtgagccatgcgatgatgccgcgcgtgaaggcatcgccgtcaccgtcgacaccccacaccttcttggcgtcgtagttcggatccacatgcgagtagccagtgccgaacgcatcgatgaacacgagatccgagctcggcagcagcgaatacgggttgtcttcgacctcaccgacgcccttcaggtgcgccatgccatcggtcttgacgcgcttggcgcccatgccaccgatgttgaccatgtacgaggcgccaccggggccgccgttccagcagaacgtcaccggacgatccgacttgtcttcctgatcggaaacctgggagaacatgaacatgtggccgatgagctggccgtcgttggcgcgcaccggaatcatttccgcggtggcggtgtagttgatcttcgtgccgtcggcgccggtccacgtgtactgcttcgtggccgtctgcggcagcggctcgagcggcttcttctgctcgccgttgccggcttcgttcttgattgcttctgtattgtctgccatggaatactccttagcttgtatagtgcatgggaggaatgccccgcgcaccgaagaatttggcgcatgcgcggccccgtgaatgtcacgaggccgcctgcgcattaggaacgcctgagctcagtgcttgggctgcgacggatcgtcctcaggcttggtcgggtcgacggcctgatccgcgttgatggagtcgatggatttgactgcggcctgtgcctcatgcgcctcggcctcgtccacctgaacgtggtgggcgtcctgcgacaacgtcgcatcgtccttcgcctcatcggtaagggccacggcctcgttgtggtactcatgggcatcttggctggcaatcttggcctcggcctcggcacggcgagcatcggccgccgcatcggtgggcactggagccgctgagacatcggcagcggtgggctgaggaatcatatcgcccgattcgttcgtatgcacgggttcaggttcgtacgacaccgtcttgacgcccacggtggggtctcccaccaaggcgaccttggccggctcggacggttcggtgatgccctgcttcttgagcagcgcagccgccacctcaccctgcttcggatccttgcccgtgggcagctccttcatcatctcatccttgtcgtagtgcttcttgatcggcaggcccattgggttctgaccttcggaaagcaatgcggtaggaatgttcgacagcgccttggaaggcttcttcaacccttcgatctgccaggtgaacggggcgaactggttggtgggatcagcccaatcgtgcttgcgggaggcacggtagatgagcacgcatgcaatgaacacgaatgcgagcaatccaatgatgatcagatcataagtggcaccggagccgacctcggcggcaagctgtgccggcgggtagaacgccagcacgatgccgaacacggaggcaaggatgccaatgccggccacaagccacgcaccgaacatgccgcctggcaccttgaagccacgcggacggttcggctgctggtaacgcaggcgcaggaacgcgacgaacatgagcacgtagtaggtgaggtacaggatcgtgatcgcctgcgtgatgagggcgacgaagccttcgacgttcggcagcaggaacacgatgaacgcgatgatcgtcatgagcgccatctgcatgtacatcaggcggctcggcatgccgtgcttgttgttgttctgcaggaacttcggcaggaagcccgaacgtccggcctggccgagcatgtaggacgggccggcgaggttcgtgatgagcgcagcgaagctgttgagcatgccgagccagcagaataccaagtagaggtcagggaagccgatcgtcgcaccgagtgcgcggtaggtggcgaacagcgtgtacagcaggttgatctgcttgttcggaatcaccatggcgatgatcagcgtgccgacgatgaagatgagcagcgcgaggatcatcgagacgaagatggccagcgggaactgcttgttcggcttcttcaggtccttgatgtgcgcggcgttcatatcgatgcccgcgaaggagaagaacacgccggcggccaacgcgagggtcgacatgccctcccacttcggcaccaatgcgctcggtgccatgtcgatggcgggcgtgtggccctggcatagccagacaacggccaggatggtcatgacgcccagcggcaggaaggtgccgagaatgacgccgtactgcgcgatcttgctgaaggtcttcacgcccttcgtggcgaggaagcagcagaaccagtagtaggcgagccagccgatcatgatcggcagcgtcaccttccacgtatgcgagttcttggcgaagtcgacggcccagtcgtacttcgtggtgaagaagccgatcgtggccgacatcgacggaatgccggagccgaaggtgaacgtggtctggaaccacagaatcaacaggcaggagaccgcggggaacacgccgatgccttcgccgacccagcggaagatgccgccgcgctggctccagccggatgcgagttcggccgccacaagacccgtcggcaggaagaacagcagtccgccgagcaggaagaaggtaactgaggagaggccgtagaacgactgctgcacgtcgttggcgagacctgcgatcaccgtgacgttcatcatgatcaacgcgatcgtcgtgaggttgccggtgcttcccttggcgcccttgactatggcgccggatttggatttcgttttatcactcatgttttcctggcttacgtccatgcgcacaggagccgcccgggattggccgagcggcatctgcaacgctatcgattacggacggggccccttcgggtctcgcgtatcacggctccgggttgaaggtgttccaatacggaagcacttcaggctcggtctccagcgccttctggtactcctcgggcaggtactccttgcgcaccgccacctcgtacatgtactggtcgaaccacgaatcatccatgatgaagtagccctggtgaccgaccggcttgccatgcgcggtggtgccccacgagttctccaccttccagcggatcggcttgccgtcggcgtcgaggtcgacgccggccatggtcatcgcatgcgtcggcaagctctggttgtactggaagcgttcgcccttgtccatgtcgaacttgatgccgaacatcttctgcacgtcgtagaggttgagcgagagaatgcccttgacgaagtcggagtcctgcagcacatcgcagccgaaccacaccggttcgccggccttgagctgcttgatcgtcgcttccttcatcacgtcgatcggcacgttcacatagtgcagcttgcgcttggagcccagcacctcaccggtcatgtcgatcgtgtacatcttgccgtattccatgccttccacaggcaggttcatcacgcctacgtaatcttcgagcttgacatcgccgaggtacttcttgtagaactcgagcggggtcagaccacggtcggcgtggtacttcttgtcggtgtcacggtattcgaagtccacggtcttcggcggttcgccgaagctcacacacaggatgcggtagatctcggagagcatggcacgacgtgcgtcgtctacttccttctccgacttgccttcgcgcacgagcttgcgcagcttgaacgcgtcctcacgcagcacgcggttgagcacggcgttgaattccgacgtgttcttggtcaccgcggtgtcgggcatggcctccagcggcaccacgccgtacttctcgatgagcgcgcagatcgggtcgaagtcgccgccgtcctgctgcggggtggcgagcaggaagtcgacacggcggtcgttgagatcggagcctgcgtacttgatgatgttctccatgaagaagttcgacttctctagcttgtcatagaagaagttgtagttctgcgagagctggaagctgcccttcggcaacttgaggctcttctccatgtggaaacgcaggaagttgagcgccgagaacatccagcagcggccggactggcgttggttcgccacggcctcgctgtcgacgtccaccgagaacacgaagttgttctcggtcacgaccacatgctcacgctcgctggacgcatggatgccgttgttcttgaccgcttgctccgcgatctgctgggcggcgtccttcttgtatgcctccgccatttgcgacaggtcttgctttgtcaattccatagtatattgaccttcattgttggttgttgtcatgccatccggttcgcacgggttgctggcgggcaacgccatgcatggcacatgcggtgcgacggggcatctgcacgaatcgggtgtacgtgtgtattgcatatgcaccataccggtgcatggaccatgcgccggggagcgcgcggatatgcgcggacccggggcaatgctggtgcgcgatcagtcgaacaacgtccagggctggctggggcggtcgtacagataccccttctgccagctccattgcgggtgctgcctcatgaattcgtcggcgtcgaacggctcgccatcggcgcggccgaagatgccccacatgtgcagggccttgatgtcgtcgccgttggcgcacttgccgtcgcaggaaccgcccgggaagaacggcacgttccacacaccgtgcggatcgtccgcatagtactgggggtcaacgtcgtagtgtgcgcagatgttgcgcgagcttgcgttgacataacccagatatgggtcgaacttgtcggcaaggattcgtttggccacatcgtcgtcgatggtgccgtgcagctgcggcagcagctgttcgaagcgtgcgcggcgggcgccggtctgctggcgggtgtcgttgtagccgttgtcgacgcattcgaggttgcgaatgcgcggattgtggcaggcgttgcacccatagaacgagccgtccttcgtgcgcagcagctcctggtgcttgaggccctgctcgtagcgggcgatctcgttcgtgttggcgtcggcgagcagccagatgttggcgtagccgccgttgttgccctcgttgacgatcgtgacccattcgtcgatgctgttcgcgtactgggtcgccttgcgggcgcggacgaattcggggatgccgtccacgtcgtagccgacgaatccggcgatcgtcgtctcggtgatggccagaccggccgaagtcacatagaagtcggtcatcgaatcgatgtagccgggcaccgtctgcatcttgaagctgttgccgtgggcgggcttcacgctctcgcacacgttgaagtactgaccgctccagaagtcgtcgaagctctcgtgggctatgaccggcttgccgtccttcgtggcactgccggtggccacgaagcccgagcagtgcgatcccttggggccgtccggcgggttgttcgaatactcggcggcgacctgcggccaccagtacccggtgagttccatccagtcgttccagccgatgacgtcgtccaggctggtctcgaagccgccggcggtgaagccgtcggccatgccctgcatctcctcgatgtattcctgtggaatcttgtccttgtgcagtttgaccgcctgatcgacgaagaacgagtaatccatgccaagcgtctcgagcgtcatatgcgtgtagacgcgaatggcgtccttaaactcgtcggtgagcaggtagccgtgctcgaagccgatctcgtacgggcttccctcaacggtcaggtactgccatccgttgatcctcgtgagcgtggccttgtccacgatctgttgctgttcgctggtcaatgccattgcatcccctttgttggaactaagcaacagcatagggagccggagacgcggcctcattttgtttacccttgaggcagatagcccttgagcggaatattaaaaggcaaaaacagcatattttccgaactctattttcttaaaacccacgccaccgccctctgccccatgcgccctgagcaccagatgatatgtggcacaggcatctgtgcccgccgacacgtattccacatcacggcataccatgtccgcacagagccaacgaagggcaccgccgaagccacgacctcacgacacagtatttcttattagacagtttgtattgaactgcacaccaattcattgccgcctcatgcgtttgccacacttgcctttcccacaatctgcaccacttggttcatgtcggtggccggcgccccgaacggccagaatgcgccgaatcgcgaaatccgaccatcgaacaacgtcgttcgctggtcaaactgcgcaggaggtcacgaggaggccgacagattcaatacgacgccgccatttggcatccgatatcccctcccaacggccagatgagttgcggatgcggacaatggccgatgaaacacgttccccaatggccagattgcggcgatatgcgccgaatgaccgctggagtggcaggaaatacgatgggcggaaatataggcggagaatataaatagacccctccaggtgatttacctgaaggggcctcgaaatgtcctgtgcgatgcccgatgacaccgtacaggaggattactgcgcgtcctgtgaatccggatcttgcgatgcgggaggaatggtgggttgagccggcgcggcaggcgctgccggtgcagcgggtgccgccggagttgcagaggcgtccggcgcagcattgaatggctcatgggccactgccggcggaaccggtgcagccgcattcggggccggtgccacaggcgtgccttgttgtacgcccgcatcggcgggcggattctcgacaccgaactgccactggctattgtcgacattgctcggatcactctgggcgggaacgccgaactgccagccgttgtcctggtacgaagcgtcgtatgccggattctgcacaggcatcgccggcgcaccattctgggcgttcttggcacgctgtttgttgtagaacgcgaagatggtgccgatgagcatgacgatgatcgcaatgatgagcagccacatgccggcgccatagctcaattggaggagcgtgccgtaccctgactgggagatcttgctgccggcggcggcgatctcgtagatgacgagcagcgtgtagatgatcgtgacggtcagtgccgcgatctcctgccgcaacacggcgagcacggcgatcacgacggcgccgatgagcaggatccacccatcgccatgtggcatgagcgacacagacatagagacaccgaaggcactgatgcttgcaaacggcaggaacacgccgatgatcgcaaggagcgcgccgacgacggtcaccagattgccgtaggccacctcatggttgccgatcttcagatgctgcttgccgagcgcgtccgcgaacttgttcaccgattccttcatatccactgtggtcgtgccagccggcgcaccctgcggggtgttctgtgcgaattggggtgcgtcgtgcggcgtctgcgacacggattgcggctgttgtggtgccgactgtgcgttggcatacgcaggctgctgcccttggggggacggcgagccctgtgccggctgcggggccggcgtcggctgggcatacggcggcaggtcgttcgacggctgcgcgccattgttctcgtttggattcatattcggtccttacatgttccgactgcgatggcagtcatttcaacatgaggcccatcatacccgaagagattacgacggcatggaaaaggccgccttataatctgtggagataatttccagagtacaggcggccttcagcgaatgcacggctcagttgttgagcggcttgaccagcgggaacgtgatcgtctcgcggatcgtggcgccggtgagcgcgatgagcagacggtcgatgcccatgcccatgccacctgccggcggcatgccgacgccgagcgcctcgaggaagtcctcatcgatgtcgcaggcctcctcgtcaccggcgagagcatccttggcctgtgccacgaagcgctcacgctgcacgatcgggtcgttgagctcggagtagccggtcgcgagctcgaagccgcgcacgtagaggtcccacttctccaccacgccgggcttgctgcggtgcgccttgacaagcggcgaggtctccaccgggaagtcgcgcacgaaggtcggctcgtacagcttgtcttcgtagaagtgctcccacaggtgttcgacgagcttgccgtggttctccacctcgtcgcgctccacgcccagacggtcggcgatcgcaccgagctcctcaacgctggtctccggcgtgatctgctggccgagcgcctccgacagcgagtcgtacatgctcatcgtcttccattcgccgccgaagtcgtactcggtgccgtcgagcagcgtcaccttggtggagccgaacacgtcgatggcggtcttctggatcagctccttgacgagcttggcgatcgtgtcgtagttgccgtaggcctcataagcctcgaccatcgtgaattccggcgcgtgcgtggcgtccacgccctcgttgcggaagtcgcggttgatctcgaacaccttctcgatgccacccacgaggcagcgcttgaggaagagctcgggcgcgatgcgcaggtagagatcaaggtcgaaggcgttcatatgcgtggtgaacggacgagccgcggcaccaccgtgaatggtctgcagcatcggagtctccacctcgaggaatccgtgttcgtcgaaggtgcggcgcagcgaggcgaccgcacgggaacgattgcgcaccatgttgcgaatcttctcgtcggcgatcatgccgatgtacggcttgcgcgtgcgggtgtcttcgttgagttccttatgcagcgtcggcagcggctgcagcgccttggcggcgatggcccactcatcggcgaagatcgacagctcgccggtcttcgatgcgatcacacgacctttgacgaacaggtggtcgcccagatccaccagctgcttgaactgcttgagcgaatccgcgccgatctgcttcttcgagagcatggcctggatcgtcgtgccatcgccggcggcgagctgcacgaagcacagtccgcccgcattgcgaatgaacagcacgcggcccgccacgccgacgatgtcgtcggtctcggcgcccgcttcgagcttgccgtcatacttgacacgcacggcgtcgatggtcgtggtgacgtcgagattcaccgggtacggattgataccgtccttgatcatcatcgcacgcttggccacacgggtctgcacctgctccgggtgcgcgagcggtccgaattccttgttcgacggatccacggcctcgtcgagcgaggcgccctcctgcacgcgcttgaaaatcgcctcgtcctggttgagcagcatttccgcgcgttccacggtgctcatctcgggggcggccactacctcttcttccacagtgatgtctgcagattcattcgcttcagtcatagcgcaacagtctaataaagactcgctacactcccccgcccggcctccctgagcgaacgcgcgcatgccacgacatacggaagcttccgtgaaacagactgcgaaagtaccgaaaacagtgcgcttctcggaagcttccgcgtaatcgatcatatgcaacacgccgacgaattgccatagtcgaccaaacgtcgtacagtaacgttctgttgcgcaaaagcaacatcgggctgtggcgcagcttggtagcgcgcttcgttcgggacgaagaggccgcgagttcaaatctcgccagcccgacgcgaaaggggttgtctccgtatggaggcaaccccttattccatttcccgtatgtccagcctgagctcagtaggcgcggcgtatcgcctgctccagatcggcgatgaggtcggccgtgtcctccaatccgattgacaggcggatcagattgtcgtccacgccgctcatccggcggaactccggcgagacctcgcggtgtgtgatgcgcgcgggatcgacgatgagcgagcgcgcatcgcctatgttcggcacataggtgaacacgtgggtgccatcgagaatccgcgcgacctgctcacggccgccatccacttcgaattcgtggtcgaatgcacgacgacgtcggcccccagttcgatcggccggaacaggtagggcgtgggtaccgtgttgtcgatgatgagcgggatgccatgccgatgcgcgacgctggcgagcgcggcgacatcggcgacctcggtggacgggttcgcgacggacccggcgaagatcgcgcgcgtgtccggcccgatcagcgactccaccaaggcaaggtcgttgatgtcatccacaaaatcggtctcgatgccgaattcggggaacaggctgtccatcgcatcgacggaggcgccgtacagattccgcgcggcgatgatgcgacctccgccttccgccgcgcacagcaacgccgcggagaccgccgtcatgccggaggcgaaggccacggcggaacggccgccctccaatgcggcgatgcgtcgttcgagcacgtcgagtgtcggattggccatacgggagtatgagaagccctctgcggcacctgccgagagcgcgtcgccgtgtgccgcggactgcatgtcgaaggcggcggaaaggtagatcggtggcactgcggcatcgccgttggtacagtccgcggaatcatagccggcgtggatggccagcgtggagaaatgggccatggtaagccagtctgtcagtggcgcagtcatatgcgcgagggaacggttaacggaagagcgacgcgagctcgagcgattgcggcgcctgcgcgtggccggtggcgatggcgagcgcctggtcgaggtcttcgatcagatcgcgtacgtcctcgatgcccacggccagccggatcagctcgtcggtgacgcccactttgagccgttcgctgcgcggcagttcgaaatgggtcatgcgcgcggggtattcggccaggctttccacggcgccaagcgagacggccaaacggaatgtctgcagattgttcagcacatccgccggattcaccccttcacgcacctcgaagctgagcacgccgccggcgccccgcagtcccttcgatgccaccgcctcgccgtgcaggcccggataatgcacgcgcgcaacggcggcgtgctcatcgagatggcgcgcaacggcgagcgcattctcctgctggcgttcgaggcgcagtgcgagcgtctggatcccacggcgcaccgcatcgcattccgcgggggcgagcacgccgccgagtctgttctgcgagtagtacacgcgggctgcgagaatgtcgttggccaccgccacgagaccggcgacgacgtctgaatggccggcgaggtatttcgtggcggaatgaatcacgatgtcggcgcccagatcgagcggctgctgcaggtatggcgtgacgaaggtgttgtcgacgatcacgatggcgccgtacttgtgcgcgatctcggcgatggcgtgcacgtcgttgacctgcagcaacgggttcgtgagcgtctcgaaatagaccgccttcgccggggcctgctcgccgtgtccgccgatcgcatgctccagctcgcgcaggtcctgtgtgtccaccgggtagctgacgagcccccaacggttgaaatgctcgttgaacagcgagtaggtgccgccgtagatgttcgagccgaccacaatgcgctcgcccggtgcgaagatcgacagcactgcatggatcgccgcgagccctgaggcgaaggcgaaaccgcgcacaccgtgttcgagctgggcgatctgccgttccaggaaatcgcgcgtgggattgccgctgcgcgcatagtcccagcgtggcatagacccgaccgattcgaaggcataggtggacgaattgtagatgggcgggttcaccgcgccggtagcgttgtccgtcaccggtacgccgtggacgagtttggtgttcagctgggtcatggcacctcctgtacagcatggattgtctgtgtgctattggtctgggtcgtgcccgcatccgtcgttgtcaggcacgggcgccactgtatcgccgttcagacgcacgaatgccggcgtggttatacgcgcaggttataggagtctgcaaatacgcgggatcgcaacgaaaaacccgctatagagcgcatctacagcgggtttcaagtgaagatgctaggagattgagaatatgatcttacgcttgggctcctttctggtgggtgtgtgggaacgtctgtggcatccggctgtcacgcaccgcgattcttgttgcgccagtggctggagacgcccatcacgatggcgatgagcgagagcagaatgccgaggccggcgaacaggtaaccggtgatccggttgaactcgacgaacgagaacatcgacgagttcatgagcagaccgaccgtgaccgtgagcgcgccgaacagcagcacgaccacgccgaacacgatggtgcccgcgctcgcccccttcggccgttccggctccggtttgcactgcggaggcgcctggtagagcgggatgttccgcggtgcgccctctccggtgctcgcctgatgtgaggcatcggtcgtctgcatcgggatcgtcaggtcatcgccgacgggctccccaccgggttcggcactgctggcattggctccgccgtcatcgcttccgccgtcgttgccgaggcccgagtccgcgtcggtgtccccggcaaattgcgcgtacaggggtgcgttcatatcgacaggtgcggtggcatccgcagcaggcatctgcgtggtgcttgtgaggtcgactcgctcgtcgatccccacggtctcgtcaagcggcccttcggcggcaaacacctcggtggcctcgtcgtcgtacggcgtctgtgcgtcgttggaatcagattgcttcttcatgtcaggctcctttcaatcagtgtttcttcgcggcgtcggcgatatcgccgccgtaggagaccgtcaccgaggcgttgcgcagcaggcggggtgagatgttgagttcggtgtgcgccacgcttttcgcattgtcggtgaggcacggccagtaatagccgttctcggcgagctgcttgacgcgcgggtcggtgttcttcgtgacggcgtggttcatgtcgtcgtcaaccccgacgttctcgcacaactcgttcatgtcgccagtcatgctgtaccacgagctgatgccgttgccgtcggggtgggcaccggagatttggaagcccgagcggccggcctgaatgtcccagccgttgcctcgatcgccttcgctgcacacaccggtggccagcaggcccccctgggcgtcaatcgaattccacgtgctcatcatgcccgacgatacgttgaaaccccatgaacacccgtagggaatcttgaccatcaccttggcatcggtgaccgtcatcggaatcgtctcgactgggcagtacgtggtcctggtctgcccgtcgttgagacgaacctgcttcgccttgttgtgcccggtatacttcgtcaggtcgatggtgagcgtggatttcgcgtagccttcgccctgcacggcgatgcccttgcgcaatgtctccatgctcgccttcgacgagtcgatcaccagcgtcttgcccacgttgacgtgcttgtaatccttggccaagtaagggctcagcgagttcgcggcccccaccgcaccgccgaagcacatggcgatcacggcgaggaacatgagcgtccatgcgaaggggtgcaggccaccggtgcgcctgccggcacaccccaaggcgacgatgatgagaccgagcacaaggcatgcgccgccgatgaacagcaccgcgccgcgggacgccccaaacaatgtgctgaacgagccgttgccggcggaaccgcagatcagggacaccaccgccatacccgcaatgaggagcccgaggaacagcagcaccaccgccggccctgcaggcttacggcgtgccttcgttgcgccccggtattcataggtgtagtccttgggctcgtagtggtaggtatagtgatatgcgctctggcttgcggactgcggttgcgctggccggaacgcttgcgccgatgcactgccagcggcgactggtggcatattgacggttggagtacctgcgtcagcggactgctgcgccggcgactgcgactctggctgggtcacattcggacgttccccacgaaagggctgcgcgggctgcgcatattgcgtgtatccgctgttctgcggggcggccgccggcatgccataccgtgcggcattcggataggcgcccggctgctgcgccggcatggaggggccggcggcgcgctcgcccacattgggcatcggcggcatgggaggagccggtgccgggcctccatagccacccgtgttgccgccgttcccaccgatgccgccattcatggagttcggccgcatgaaccggcggcgcccgtggtcgatgacgaggtacatggccagtgcggaaagcagaatcggcatcacgttcacggcaccgtggaatccaaagaacggcacgaccaacacgcccgaaagcaggatgcataggatcacgccgatgaacgaccagttccagtgcccatggatgaggtcttcgagcaggatcgacccgtcggattcatcgggcagcagcgcccaggcgagtccgtagaagaacacgccggtgccgcccatgaatgccaacacgaccatgagcacgcgcacgagcgtgacgttccagccgagctcctgcgcgatggcgccgcacacacctgcgatcacgcgattgttcgtacgctgcacgccgctttcgcgaatccagcggaagaacgaggattcagggcgttcgccgccgttgttggcgttcggcgtgggacgcccgttctcatagtcggtgttgtaggtggtgttggcattgtaggaggtgtgagaatactggccttgcccaggctgaccgtactggccggcggactggccgttgccgagggtctcgccctgcggctgctgtggattgtggtttgcgttgcccatggttccattacagcagacggcggattgctcaggcatcgggggacaccccgattccgaccctgatttccacctgaggcaccccctacctcccctgaatgcggcacaatggaaccatgagtcagattcccgagcatctcgctcccccgctactgcccgccaagctgccgctcttgcgccccaaacagggtcgtgtgatcgccggcgtggcccgcggcatcagcatgcatctgggtgtgtcggtggcgttggtgcgcatagtgttcgtactgctcgcatgctggttcggcgtgggcgcgctcgcctatgtggcgctgtggattgccattcccgaggggaatcccgtggccgaggctgcccggttgcgcggcacccacagctcacgcaatgcaccgcttgccagggggaacgcctccgtgggtgaatccgaaagcccgctcttcgtatcgcagacgctcgactcggcacaggatgcctggtatgcctacaccggattggaacagtctacagactctccctctgccaaggactccgtgcgccgcacactcgcgaacgcctcgaaaccggccatattcgccggaatcggcgtcgtgctcatcgcgttgccatccgggttgaacgcggtgatgcgattctcgggaagccagatgctgccgattgtgccgtgtttggcgggcatgggcctgccgtggctcaacacgcgcgcgcgcaacgggcaggcatggctgacgctggtgggcgaaggccttattttcaccgcattcctcgtgttcgtggcacagacggtcgccaggaatggcgccgtgccgttcggttcggcgatcgcctgcggattcgcgttgctggtggcggcaatctgcgcgctgattccgctgctgatgacgctgattcgcaatatatggcaggaacgcgcgctcaaagagcgtgaggaggagcgggcagacatgaccgcgcatctgcatgacggcgtattgcagacgctcgccttgattcagctgcatgccgacgatgagcagcaggtgttcacgctcgcccggtcgcaggaacgcgagttgcgcagctggctgtaccaggaacggaccacgagcgacaggtcggtgagcgccggtctgcaggagatcgccgcacaggtggaagacacgcatggcaagccgattgaggtggtcacggtgggcgacgcgcggccgagtgcgcagaccgatgcgttgctcgatgcggcgaggcaggcgatggtcaacgccgtcacgcacggcggagaaccggtctccgtgtattgcgaggcggatcggcatcaggtggaggtgtttgtgcgagaccacggcaacgggttcgacatcgacgacattccgcccgaacggctcggcatacgcgagtcgatcatcgggcgcgtgcgccggcgcggcggcacggtggagattgtgtcgagacccgactggggcactgaagtgcgcatgcatatgccgcttgaggcgggtttcgactcctcgcgcacgtcggactcccccaccgaccgtcccgcccaatcgggcgatcccatacgacctgcccaatccacccaatccacccaatccacctaatctgcgtaaaaagagacaaaaaccgccgcgcagatgtcccaaattacgcaaactggagcctgcgtcagccggcctacctcatctctgcgtaaaaagggacagattcggcacgcagatgtcccacattacgcaagtggagccgcccgattacgcaggccgagccgccaatcacatagacggggcagatcacacaagcggagcccaaacgggcggttgacgacgcaatgcaggcggcgggtagactgcagaatcagaggaatatgaacgcgcacgagaaaaacggagggcgccgatgagcgagcgggaacgacagggcattcgcatagcggtggtggatgatcatgagatgttccgcgcgggggtgatcgccacgctgcagccgtatttcacgattgtcgggcaggcggcggatgtgccgagcgccatcgagatgattgcggacacccagccggacgtcgtgctgctcgacgtgcatgtgccaggcggtgaaggcggaggtggcgcggagattctgaggaagtcccagccccatgccccacagacggcattcctggcactgtcggtctcggattccgcacaggatgtgggttcggtgatccgtgcaggcgcgcgcggatatgtgacgaagacaatcaccggcaacgacctgatccattcaattgagcaagtgagcgacggatacgccgtgttctcgccgaaactcgccggattcgtgctctccgcgttccagggggcgccgctgagcgacggcatggacgcctccaatgaatcggctgccggcggcgacaccgtggcgcacgatgccgagctcgactcactgtcaacacgcgagcaggaggtgatgcgactcatcgcccgcggttacacctacaaggaggtgggcgccgaactgttcatctcggtgaaaacagtggagacccacgtgagcaacgtgttgcgcaaactgcagctctcgaaccgcaacgagctcacgctatgggctgccgaccgccatatcgtctaggtttgccgccacgggttagaatcgcaaggtagcagttcacggaagcgaggcggcatggacgatcaacgtgatcttgagcggatgctcggcaatctcaggcaattccaaagcgaatcggatgcgtcgaaggagtcggagaagagtccgtcaaacgcgggcaccagctttgacgccgacgagttccttgctggactcgatgcgatgttcgcctcgcataccgccaaagacaaggccgacgagtatctgcagcaggcgatggccgacgccgagaacgcgcaggactatgcgggtctgctcaccgtgctcaacgagacgatgggattctaccgttcgcaggggcgtcatcaggagaaccagtggatcatccagcgcgccatcgagctggcactgcgtatgggcctcgaaggcaccgaggcctggaccaccacgctcatcaacgcggccacatcgcaacgggccgccggcaatctcgaccaggccgaggatctgttcgaacaggcactcgacgcggcacgccgcacctacgggccggacgatcgccgtcttgccgccctccacaacaaccggtcgatgctgttcagccagacgcaccgcaggcggcaggcaatcgatgaactccacgaatcgctgaggatcctcgaacattcgagcgtggatgcccagtccgacgtggatatcgcctccacctgcacgaatctcgccctcgctatgctcgacggtgaggatcagcccaccgacgccgaactcgaagaggcgcagtcgctcgcccgtcgcacgctcgacatctaccagcatgccggttccgactccagcgcccactatgcatccgcattggccggggccgcccacgtaagcttcgcctctgaagactatgccgaggccgtgcggcaataccagcgcgcccttgacgtgatcgcccggtgttatggcgagcacaccgactactatcgggtcaccgcgcagaatctccaggaggcgcagcgcaaactcgagttgacgcaatccaccgacaatccacatgattcggtggatgactcccccgcacaatccaccgtccacactgatatccaccgttctgcggtgcataatgcgagcgtgccgtccacaatgcaggcctccgcacagcattccacgtcaccgcgaacgctcgcccccggcaccgcactccgcgtcgccgaacccggcatggctctcgccaaagcgtactggcaggagctcgtcaaaccgatgatcgacgagaggtatgcgagtgtcaagcatcgcatcgccgcagggctggtgggtcatggttccgaatgctacggtttcgatgacgcgctctcccgcgaccatgatttcggtccgcgcgtgtgcctgtggctcaccgctgacgactatgcggagttcggcgagcgcctgcaggcagattatgacgccctccccagcatgttccacggtgtttcacgctccgccgccactccacgcgcgcagggtgagggtcgccgtgacggcgtgttcgaaatcgccgcgttcttcacgcagctcaccggtatgccccatgcgccggccgacgacgaaccgcatctgtggctctcgctcgacgagagcacgctggcggccgccacgaatggacgcgtgttccaggatggtctcggcgcattttccagtgcacgccaatcattcacccgcatgcccgacgatgtgcggctcgccttgatctcgcgcagacttggcatgatctcgcaggccggccaatacaatctgccgcgtatgctcgaacgcggcgacggcgccgctgcgtggctctgcatcgagcaattcgccgatgccgcgtcgtcattggtgttcctggtgaacaacccggcgagcgtgggctatgcgccgtactacaagtggcggttcgccgcactgcgccggctgagtgcacgcccggcgatgctgctcaccgagatctgcggcgagctcgagcaactgatgcgtctgtcaagcgcagcctgtttcggcggcgcgggcttcggcgaaggcggcaaaggcgcggcaccgagcatcgacacagtgaacgcgatcgtcgagacaatctgcgaacagatcacccacacactcaatgcgctcggcctgagcgattccccgcagaccttcctcgaatggcagcggccgtatgtggaggcgcatatcacgtcgccggcgacctgcctgcacagtctgtaatccaccgaagcaaggaataaggcggcgatatgagcacacggcagacgatcaaatcgatcatcgaacgcgaatgggaccagttccagcacacgaacaacgaaggtggacgcgcaagctgccagggcaaccggccgatgttcgaggtgatgcgcgcaagccagttcgccgcatggccgcaggagctgctgacaagctaccttgccgacctgcgtgaggccgatgcgggcggacgcaatctcgtcaccgagaaatacgcgcgcatgatggcgtcgacggcgcccgagatctacgcgcgcgatctggaaccgcatctgccgcgattatccgaggcgcgcatcgcgcagcaggaacgcatcatcaagcgacagctcgcatgggcgcatgagttcgccgaccggtaccccgcacttggcgcgggtatgcgcgtgttcgacaccgccgaggacagcgagaccaccacctcgttcgaaacgtacctgcgcggcgaattggccacatattcgcagcgcacgctcgacctgtacgagcggttcgtgcgggaatgcgaacgcaggcaggagaatctgaccgagcagatcatcgccaacacggtgcgtctcgggggctatacgaatctggacgaggcggaggcggcgcagcgtcgcgcataggcgcgcatgtcgcggtaagaggaatatctgccgaatcggtacagtgttactgtgcagcattttttcagacagcttgcgtggaccttcggcgtgtccatcgtcatgattgcgctgttcgcaggacttggcatcgcgatggaaccgaaatggtcggtgaaaccgctcagcatgcatctgcaggttaccgagcgcagcacggcgatcaaagcgcgcggcatcaccaccccgcaggaaggcacctaccaggtcaggcagactcgtctgcggctgcccatctccggcggcaagacggtgaacgcgattctgcgcgagcccgagaatgcacccagcggccgcgcggcatgcgtgttcgtgcacggtgcgggcaccggcaaggcggaggaggtgtacgccgatcttgcgaacgcgctggcctcggccggcatcaccacgctcgtgcaagacaagcgtctcgacaactacacgccgttgcgccgcgactatgactcaagcgccgaagactacctcgcagggctcaatctgctgcgcgcacagcagggcgtggacgcgcgcaaggtcggcctgtacgcagaatcggaaggcacatggatcgcctcggtgatgacgcataaggataggcacatcgcattccaggtgctcacgagcgcgcccgtgtattccggtcgccagcagattgcgatggcggccactgaatacctgaacatcatcggcgcgccaggcggcgtcgtcgacatcataccgcgcctgctcagtctcaacttcgcaccgatcggccttgaatatgccgatttcaacacagccgaataccgtgatacgctcacgatgccgctgctcgtcaactacggtacgatcgacccggccatgcccatcgaacagggcgcgctccaactgatcggcgacgcccatgccgccggcaattcgaacgtgctcgtgcgctactacgccgccaaccaccagatgcgcaccggttcctcgctctccttgcccggactgccgctcgacaaggactacacccacaatctcgaggattggatcaacgcgattgccgccggcgcgaccgaggacgattggctgacgcctgacatcgcggggcacgcccctatcaggaatatgcgataccggagaacatctcctccggtctcgtatcgtcagtctgggtgctcgtggtgctcatcgtgatatgtctcgtctcgtggctgctcacggtcgtcttctgcataggcgcattcgtctcacgcaaacgggtggaggcgaagactgttgatgacagcgggcacattgtggtgcaccgtttcaccatgctttccaaagtgctcatcatcacgaacatcgttttgctgccgatatgcgcggccggtttcctcggctatttcgcgttcaccgcgaaggccgcgctctcgctgaccgatgaggccaccatgctctccttcggctggagcatgctgcggttgggcagcctggtgctcattgtcatgaacagctggatgtgggtgcgcatgttcttcttctacggccccggcaacatcgacaaggaatacccgaagacggccatgcgcatggcttccgggcataccgccaccgtcgccctcctgtcggtgagcgtgctgtgcgcgctggtgctcagctcgttcttcggcctcattggctgaggcatgccggcaggcgcattcatgcctaagaccgaatgagaaagcgggctgcagatatgtgcatctgcagcccgctttctcttataggcttattaggtttatagacctaacggtcttggaatcactcgccgagcgccttgtcgaccacctcggtggcctccgtgagcacgctgtcgagtgtctcgggcgagacgaacgattccgcgtacaccttgtagatgttctcagtgcccgaaggacgcgcagcgaaccagttatccttcgtgacgaccttgatgccgccgatcggcgcatcgttgcccggggccttcgtgagaatctgctcgatcggctcgccgccgagcttcgtggcggtcacatcggaggcgtcgagcttggcgaacttctgcttctgctcgagcgtggtcggcgtgtcgatgcgcgaataccagctctcgccgaaacggtccacctgctcctgatgcagctgggccgggttcttgccggtcttgccggtgatctccgcggccagcaggtcgggaatgatgccgtccttgtcggtggtccacacacggccgttgaaccgcaggaagctcatgccggagctctcctcaccgccgaaagcaatctcgccggtgaacagcgggtcgacgaaccacttgaagccgacgggcacctccaccaccggggcgccgatcgaggcggccacacggtcgatgagcgaggaggagacgagcgtcttgcccacgccggtgtgctccggccagtcggggcggttgccgccaaacaggtattcaacgcagacggccaggtaatggttcggattcatcacgccccagttcgggcagacgatgccatggcggtcggcgtcggggtcggtgccgcccaccaggtcgtacttgtcccaagcaccggcattgagcgcgtcaaccaggcccttcattgcatactgcgacgagggatccatgcggatcttgccgtcgtggtcgattgtcatgaaacgccaggtggggtcgacctcagggcggatcacgccgatgttcagaccgtacttctcgttgatgagcggccagtagttcaccgaggcgccgccgagcgggtcgatgcccagacgcacgccggagtctcgaatgacatcgaagtcgatgacgttcttcaggtcgtccacatagtgctcgcggtagtcgaaacgcttgacgaactcggacttgacggcctgttcgaacggcacgcgcttgacgttgcggaagtcgccgagcagttcgttcgcgcggttggcgatcgcattggtcacgtcagccggagccgggccgccggtgaccgggtcgtacttgaagccgccgtcggtgggcggattgtgcgaaggcgtcaccacgatgccgtccgccagacccgggccttcgaagcgctgggtgccgtcagcggcacggttgtgcgtgagaatggcctgggagaccaccggcgtgggcgtgaagtcgtcgcgcgaatcgatgcatacagtcacgccgttcgccacgagcacctcgatcgcggtcttccatgccggcaggctcagggcatgggtgtcacgaccgatgtagagcgggccgtccacgccggctgccttgcggtattcggcgatggcctgggagattgcgacgatgtgcgcctcgttgaacgacgtcttgagcgacgatccgcggtgtccggaggtgccgaagatcacgcgctgctcgggaacggacggatccggaaccacgtcgtagtatgcgccgaccacttcgtcaacatcgatcagatccgctggggttgcgggaagtcccgcgttctttgcaaccatactttcctcattctgtagtgttcagattgcgtatcccgcacatcatatgcgggagctgactccagtctaccgcggattcgccgaacagaaagccaacgacgccaagatatgcaatcgtttgcacacctgtggcatgtcacgccttcgcaccgattgcgatcaccgcaatcttggcttgccgctcgcatccacacgaacgggctgcagattgccggtcatctcggcatcctgcccgggcgcgcgcacgatgagcgcattgtgatccacggagaaacggatgtgccgggtcggtttcagcatgtcgccatccacctgcgcgggaaccggcttctccaactgcagttcggcgctcacgccctgcacctggtcgatcgtcgaatgcaccgacagcgggctctgctgggccttgcgcgtgatcgtctggtgcaccacgtcgccgaacagattcatccagccaatgatgccgccgttcgtgtcgatcacctcgaaatcgagcagaccgtcgttgaacgaggcgtcgggcatgagcgagaacaccggaatctcgccgcagttgccgctcatgaacgtgcggaactcgacatcctcgcgcacatgctggtcgccgttcgcgccggtgagcaccacgctcgcatggtatttgggggcgaacagatgcttggcaccggccacgaagtaggcgagccaactgatgttcttcttgagcttggggtcggtgtcgtcgatcatcaccgcatcgaagccaatgccggcgatgattaggaaggcatgcgcatgatcctcttccgggtggtcgagcagctgcagtcgaccgatgtcgaccttgtacgacccatgcgagatcgcaatcagcatcgccgcctcgaggtcacccaccggaatgttcatgtttcgggcgaacagattgcccgtgccgatcggaatgatgcccatggcatggttcgtgccgcccatcgcactcgcgaccgtgcgcacggtgccatcgccgcccaccgcaatcaccacgtccgccccctgctcgagggcttcgagcgcacaggcgcggccgtccttgtcgagctgcgtttcaatgaacatgatgtcggcgatgccacggttcgtgcagaaacgctcaataaacgcgcgcgtctcgccggccgtcggcttgctcgggttgattacgaaggcataatgcaccgcgtccctgcggcgttcgttcttgatcgtctccacacgacgtatgtgcaacgcgatgcgaatgccgacgacggcccccacgatcacgatgatagcggcgatcatgcatacgagaatcagcacccactgattgtcacccattgcgctccttcccgtaggccagcatccccgattttaccaaatgcacctttcgggcacgtgcggtggtgtgtagaccggcggcgaatacacggatcaccgcccccgtgccgcacccgcgaacatgcgtgaaaaacgctgcaatctgtcggctttgcacattagagttgaactatgctcgatattcaattcattcgtgaacatcctgaagtagtcaaggaatcacaacgcaaacgcggcgaatccgtcgaactcgtcgacgaggtgctccgtgccgacgaggaacgccgctcctcgctcaagcaattcgaagaggcccgcgcccgccagaaggagatcggcaagcaggtcgccaaggccgcaccggatgagaaggcgaagctgatcgcgcagaccaaggagctctccgaacaggtcgcctcgttcaaagcaagcgccgacaccgccgacgaacagtacaccaccgcgatgtggcagctgtcgaacatcgtggaaccacaggcgccggaaggcggcgaagacgactacgtggtgatgaggaaggtcggtcagatccgcgatttcgcagccgagggcttcgagccgaaagaccacctcaccctcggcgaggaggtcgccggcatcgatatgaagcgcggtgtgaaggtctccggttcccgtttctacttcctgcgcggcgatgtggcacgtctgcagatcgccatgctcacgatggcggtggatcaggcacaggagcacggtttcatccttgcgatcacacctacgctcgtgcgtccggaggtcatgcgcggcaccggcttcctcaactcgcacgccgatgagatctaccgtctgcgcgagccggacgacgactatctggtgggcacttcggaggtcgcgcttgctggcatgcacgagaacgagattctcgacctgagcgacggtccgctgcgctactgcggatggagctcctgctatcgtcgcgaggcgggcgccgcaggcaaggacacgagcggcatcattcgcgtccaccagttcgacaaggtggagatgttcgtctatgccaagccggagaactccgatgccgagcaccagaagcttctcgcgatggaggaggagatgctcgccaaggtggaagtcccgtaccgcgtaatcgacacggccgcgggcgatctgggttcctcggcagcacgcaagttcgactgcgaggcctgggttcccacgcagggccgctaccgcgagctcacgtccacctcgaactgcacgcagtaccaggcacgccgactcaacattcgcgagcgcgttgccgacggcggcacctcccctgtcgccacgctcaacggcaccttggccaccacccgctggcttgtggcgattctcgagaaccaccagcaggccgacggttcgatcgagatcccgaaggccatgcgtccgtacatgggcggcaaggaagtgatcgagccgcgcaagtgggaggcctgagcatcccctgagccggcaatgatctgtgccggcatacttcgcaacgagcgggcgcatatgcccgctttttgcgtgattggagacagctgcagctcgaatctatccccttttacgcaagaaatacccagcatatctcgtacttttacctttaccttcgccttcactctgcgtaaaaagagacaacagcacgctgaatttgtccccgattacgcacgacacactctttacgcacgacacactctgcgtgattggagacagattgggctcagacatgtcccggattacgcaaagagcagccatatgctacactgaatagtcgtgtgcggcgagtccgcctgcgcatatggataggtgtccgagcggtctaaggagacggtcttgaaaaccgttgacgcgcaagcgtccgcgagttcgaatctcgccctatccgcccgccggggttccgaattcgattcggagccccgttttttcatacgcgttcctgccacatgcacgttcccgaggtcatcggcacatcactctgcattatgcccggcctgcagtcatatcgtttgcctgtgccatgtttgcaaactcatctttgttccgaccaccgcggcgcagcagttgtgtcatatttgcaaattcaatctcaggccgcccattgacgaccggcataacgcgccatattcgcaatctcaatctcagatcagtcactgcaagacttctcgcctgccttgctgagacctaatctgcaaacgagaccattgagaagcgcacaatcgtgtcgtgtttgcagattccatctcgggtcggtcatcgagagccccgcagcaatgccatgcttgcaaatctggtctcatggcgatactgcagacaaaccgcaacatgccgcttggagatcgaaattgcaaagacgacaccgcacacagatacaacatgccgtgttgagattgagcatgcaaaggacaacaccgccaacagatcacaacatgccataaggcgactgagattgcaagagcgacactcaaggcatacacgcaaccgaaggcaccccaatacgattgcgaccctcgagacgggtgcatccccgaaggagcccggaatacagtcgccacatgggaacacgcacacaccaacccagcgccgaaacggcaacgagaccgatgatgagaaatatccacgattacgtgcgcctcacacaatcacaacgtgacaatgatagcggcccgcacgtagagtggaggcatgacgatcacagtttccacagatggctccgcactgcgtaatccgaacggcccgatggggtgggcgtgggccgaccatacggacggcgcgcgcgacgaacacgcgcatgcgggcgattgtgcggcagggggcgccacgaacggcacgaatcagatcggcgaactgtgcgcagtgctcgaggcgctgcgtgcacacccgggaagcgagccgctggtcatagaatccgactcgcagtatgccatcaactgctcgagcaaatgggtgttcgggtggaagaagaacggctggaagaactcgaaacaggaaccggtgaagaacgcgccgatcatcaaggcaatcgatgcggagataagcaagcgggccggcaaagtgagcttccgctgggttaagggtcacgccggcaatgcaggcaacgagaaggtggacgatctcgcacgcggattcgccggcgattgcgaatccggcgcgcaagaggggtatctgccgaaggaaggttggcaggcgctgctcgagtcgccgtacgcacgcgatgtcaaggtgcctgcggatgcacaactgctgctcgacggcgagatggacgaacgcgaatacacgcggttgcatgccgccgaggtggacgatctcgagcacggcgagccgaatctgaccgagctcggcgacgtgcggactccggcggattccgcagaaaccgacgcccctgcggataccgccgcacatgccgcggaatcagcggcggacggcaccgacacccccgcaggagagcccacagcgacggccggcatgcagctggcgcccacgggattggcggcaagcgggcgtgtgacgctctcccctcccccgaactcgagcccgtattatgacggctcaccgaggcgcatccacgggtacatcgaagtggacgcgctcgtgcagggcgacggcacggtcgatctcgagaatgcgcgtttcctcatgcatcgccgcgagaacggccaggaaacccgccagtgagacaacacgagcgttcgcaagcatgttctagtatgggaatcagattgcgtgcataggcaacgcaacgtgcacactcgctaaggagagtcatggataaagcacagcaggatgcaatgaagaaggaggccggcatcgaggccgcgaagctggtcaaaagtggcatgatcgtggggctcggcaccggttccaccgtgcgcttcctcgtcgacgaactcggccgccgcaagcaggaggaaggtctggagttcaccggcgtcaccacttcgcgccgcacgcaggagcaggccgagggctacggcattaagatcgtgaacatcgacgacgtcgaccacatcgacctgtgcatcgacggagccgacgaggttgacaagaacttcaacggcatcaagggcggcggcgcggccctcctgtgggagaagatcgtggcgatcaactcgaacaggatcgtctggatcgtcgacgcctccaagctcgtcgacgtcattggcaagttcccgctgccggtggaggtcattccgttcggcgccatgcatgtgatcgagcgcatgaaggaacgcggctacaacccgacgctgcgtcttgacgccgaaggcaagccggtgcgcaccgacgagaacaactacgtcgtcgacctgcatctcgagcgcatcgacgacccggcaggtctcaacgaggatctcatcaacatggtgggcgtcgtcgaagacggcctgttcctcgacatggtcaacgaggtcatcgtgggcgatccgaacggcccgcgcacgctcatcaatccgaacaaggcgtgagcattcgcaagacattccggtgtgttccgggcaacgaccgcgtgcgggaagcgcgcggtcgttctgttatcgggagccgaacgccccatgtcgtatacggccgcatatatgaaattcccgcacacatcgctgcgtgcgggaattgttaaagcctagagtataagactacttgcgctggtggcgggtcttacgaagcagtttgcggtgcttcttcttgctcatacgcttgcggcgcttcttgatgacagagcccatctcaagcctcctctatagatatctaaagattgcaacttgcaacagtctacacatgtgagcagactttcgcgctgggtctacagcgggaacagctggtagaccgagaccaccgaattcttcgtaccggtcacgctgaacaccacggtgtcgttgcgccagactgcagtggcctgcgtgtcgtcggactcggccgtcttcacctcgtaattgccggtgacgtcgccgttcaccttcacgacgccgttggccagcgacgaccccttgagatcacccgtaagcttcgtgtactgcccctgtgccttctccgagtcgctccactgggcgacggtgagctgcacggcgtctttgtcgttgccgttcgaataggtgagcttgtattcctcaatcgggttcgaatcggcccatgcatcggtggaatcggcttggacgcgcgcgaaattcgaaacatggtcgggcatcgccctgagcagtgcggtggcgtcgccgggcaacgccttcgccttcaccgtggccttggagggcgtcgccgtgggcactgccaccggttttgccggcgtgcgcaccgcccaacccggccaaccgaatgcggagacgagtgccagcacgaacagcatcacgaacaccgccaccacaatgcgcacgtagcgcagtgaatgcacggcggaggtctgagtcggctgcggctgcctccgcgcccccgactgtgacgttcgccttcccgcatttgacgggcctttggaaccgctgttgtttgccataccgcaatcttgtcacagccgcatgacggtgtagcggctgcatgaaacactgcgtggaacacatgcgccgctatgcctgttgtatggaatcagatacagtgttggcaggcgataaggagtggcatggcgaagaaaaccgtgaactatgtgtgcaccgaatgtggctggagcggcggcaaatggtatggccgatgcccggaatgcggccaatggggcaccatcgaggaattccatgaggctccggcggcaaccggggcacgcacgccggcgcctggccgcacctcgcgcacgcccatctcggtgccgaatgtgcagagcgcggcgaagccgatcacgagcatctccaccgacacggtgaaccgactccccactggcttcggcgagttcgaccgtgtactcggcggcggcatagtgcctggttcggtggtgctcatcgccggcgaacccggcatcggcaaatcgacgctgttgctcgagaccgccgggaacatcgcgaaatcggtagccgccgcgcatagccgcacgccagacggttccgattcggagccgcatgacgcgcatgccggcacacacgacagcgtgctgtacatctcgggcgaggagtcgcaggcgcaggtgcgtctgagggcctcacgcatcggcgccgtcgaggagaacctgctgctcgccgcgaccaccgatctctccaccgtgctcggcctgatcgactcggttcggccggcgctggcgattgtggattcggcgcagacgattgtctcgcaggacgtcgatggcatctccggcggctccacgcaggtgcgcgaggtggcgagcgcgctcatagactccgcgaaatcgcttgacgtgccggtgctgctcgtgggtcatgtgaccaaggacggttcgattgccggcccgcgcacgctcgagcatctcgtcgacgtggtgtgtcagttcgaaggtgaatcacagaccgctctgcgcctgctgcgcgcggtgaagaaccgcttcggccccaccgatgaggtgggatgcttcgacatgagcggcgagggcatagaggaggtgcgcgacccggccgggctgttcctctcgtcgcaaaacgaacccgttgagggcacgtgcgtgacgttcacgttggatgggcatcgttcccttgccgtggaggtgcagtcgctcgtgaccaattcggtgctgcccaccccgcgccgcgccgtcaatggcgtggatccgagccgcatcgccatgctggtggcggtgctctaccggcatggcggcatctcgttgctgcagaacgatctgtacatctccacaatcgcaggcggtcaggcgaaggaaccgggatgcgacctcgccatcaccgccgcaatggcgagcgccgcgttgaacaagccaatcgccaagaacgtctgcgccataggcgagatcagtctcacagggcaggtgcggccggtgccacgtttggagtaccgtctccgtgaggcgcagcggctggggttcacgaaagcgatcgttccggcgacccaaaagccgttgaagatggagggcatgacgctcgctccggcgacgaacctcaaagacgccctcgcgttcctccatctcgccaagcagcgacattagccgcgggaccgctattcggctcccaacagctccttcgtctcctcgacgttgtgcttgagctcggccacaagctcgtcggtggaaccgaatttgatttgtgggcgcaggaagcgttcgaactccacgcgaacacggtgcccatacaggtcgagccattcgtcggtgagcgcatacgcctcgagcacgcgctcgttgagcccggtgctctcgctgtaggtgggtttcgtgccgatcgagatcgctgccggccacctgaatggcgattgtgcagccagtcggctgtcgacgcgcgatgaggagaagcggtgcgagaccaccggggtatcgcttacggtgacgctcgccgcttctaccgcctccccatcggcggctttgccgctcagctgctgctggtcgcgctcgtattcgtctgcaggtcccagatcgacgagccagccggcatacacgccatccaccggcaggtacccctccatcggctcggctatgttcgccgtcgggaagccgatggttcgtccgcgttcctcgccgtgttccaccacaccttccacggcgtgcgcgtggccgagaatctcgtttgccgcctgcacgcgcccctggctgagcaggtatcgcacgttcgtggagctctggttgcgcacttcgcgcgcgttgtgcttcttcgaccaggcgcgtcgctcggccttgcccagtccctccagcgggtcgccgggttcacccggctcgttcggcgccgtgggggtgaatcgttccggcacgcgcacggtgccgccctgattggtcaccacttcgagttcgaacacgccggtggcctcggcgagtgtgcgaatcttcttgatgtcgccttccagattcgcgcccatgcgcgcgtcctcgccaagcacgagcatgcgcatgccgagtttgcccacaagctggccgaggaagaatctgaacgatttctcggagaacgcgatggtatagcgcacaatgagcacatagtcgacgtgcatgcggctgagcatgcgcagccgcgcgtccacgccggtgatggcctcaggatcatgcacgccggccggcacgtctttgcctgcatgtgcctttgcataggcgtgcacgaatgccgggcgtggatcgaacatgatgaccaccgagtatgcgtcgagcttcctggcttggcgcaccgtctcctcgatgacggcatggtggcccacatgcaggccgtcgaacgcacccaccgtgaccaccgatttcttcgatgtgctcaatgtcggccatgcgacgttgccgtccgcagctggtgtcaaacgaaaaatatccatatatcctctattcgtttcccgtattcgcagcgaacaccgttaccggcttgaattcgtggtgtttcgcgcgctcgacaatcgccacgacctcaggctcgccatcggcggacccaatggcggcccacacgtgctcgccgtggtggtgtgccggtcgttcatcgtcggtcggtgcctgtgcaacgattctcctaccaaaacgcaaatccgccgcctgcgcttcactcacggcgagcaccggcagcgtgagctgtgcggcctgcaccatcgtgagcagatgcccggccaaatcttcccccacacaatcgagcaccgcgcgattgcgggtgatctcctcgccgtcgcggttcacgaaggtgcgtgcctcggcatgcgcgcgcacaatgcgggcgtcacgcacgcggaacgcccccaccgcttccctgcgcaggcgggtcagatgcgcgccgcaatggaaatcattgccgagatcgcgggcgagcgcgcgaatgtaggtgcccgccgagcaggtgacgcgcacgtcgacatcgagcaccggcgtgccgttcgcggcctgcgtttgccgaccaccgagcacatcgaacgcatgcacggtcacccggcgcgccttgagctcgacatgccggccttcacgggccagatcgtaggcgcgttggccgttcaccttgatcgcggagacggcgtttggaatctgctcgatgtcgccggtgtattcgttcgccacggcttcgcgcacctgttcgagcgtcggcagcacggcggcctcggcttcccgctccacgaactcgccgtcggcgtcatcggtggttgtgcgctggccgaagcgaatcgtggcgctgtaggttttcgtgtgctcgacaatgtactgcagcagacgtgtggcatgacccacgccgatcacgagcgcgccggtggccatcgggtcgagcgtgccggcgtgccccaccttcctggtgtgcagcgcggcacgcacggccgccacgatgtcgtgactggtcacgccctgcggcttgtctacaatgagcacgccgttcaccttcgcgtcgcgttttccggtgcccacgccttacttgtcctcgtcgtggtcgtcgacggtgtcgatagtggatgccgggtcggtcgccaccggatccacagggtcgtcgtcggaatgctcgaggtcgtcgccactgttgtcgaagtcctcgaattcctccacttccaccacgtcgcccgggtattcggtgtattcgtccttgttctcatgctcctgctcgtccagttcctcctcgacggcctcctcggtctcgtcgtcgtggcggtatggatcggcgtcgccggcgtaggcggcgttcgcgcgcatgcgggcgagctcctcgtcgcgcttgcgtgccagcgagagaatgtcttcgatctcatgcgcctcgccaggcacctcgtcgaagatgaactggagctgcggggtcaggcgcagaccggccttggcgcccaccatggtgcgcaggcgtcccttggcctggttgagcgcctccttggcgcgcttgcgttcgccctcctcatggccgtcccggctcagcgtggtccagtagatcttggcgagctggagatcattggtcaccttgacgtcggtgatcgtcacgttcttgagtcgcttgtcgtgcaacgtggattccatattcgaggcgatcacacgctggatgagcgccgcgatgcgggcggcgcgagaattggttccctgcatggtgttccttactgtttgacgtcctatgcggttctgctattcaacactagtcgaaaaccgccatgtgcattgggtgaaaacggcagacgcccgtagccgggtgggctatgggcgtctgcctgcgttactcgcgcgcaatctgcggattgcagactacttgcgctcgatctctcgcatctcgaaggtctcgatgacgtcgccgatctcgatgtcgttgaagttgccgaggttgatgccggcctcgtagccttcggtgacgctcttgacgtcgtccttgaagcggcgcagcgacgagatctcaaggtcgttgaacgtggtcacgccgtcgcgcagaatgcgggccttcgtaccgcgcttgacctcgccgtcgagcaccatgacgccggcgatgttgccgaacttcgacgagcggaagatctcgcggatctcggagtgggaggtggtgacctcctcgtattccggcttgagcatgcccttgagcgacgcctcgatgtcttcgatcgccttgtagatgaccgaatagtacttgatctccacgccctcgcgctccgcgagatccgccacctggcggttcgggcgcacgttgaagccgatgatcacggccttgtcgacggaggcgaggttcacgtcgttctgcgtgatggcgccaacaccgcggtggatcacctgaatgcccacctcgtcggagacctcgatcttcatgagggagccctcgagcgcctccaccgaaccggaggagtcgcccttgatcacgatgttgagcatgtcgatctcggactcggcgaacttcttcttgaactcctcgagcgaaaccaccttgcggcgcttcgcgagctgggccgcacgttccgtggcctggcgcttctcggcgatctggcgtgccgcgcggtcatccggagccacgaggaacaggtcgcctgcggtgggcaccgaggtgaggccgagcacctgcacaggtgttgacggcagcgcctccttcatgtgcttgccgttctcgtcgagcatggcgcgcacacgaccatacgaggtaccggccacgatcgagtcgccgatgtggagcgtgccggactgcacgagcacggtcgccacagcaccgcggcccttgtcgagtcgggcttccacagtggcgccgcgggcatccatatccgggttcgcacgcaggtcgagctcggcgtcggcggtgagcagcaccgcttcgagcagcttgtcgacgttcgtgccctgcttggcggagatgtcgacgaacatcgtgctgccgccatactcctccggcacgaggccgaattcggtgagctggccacgcaccttctcggggttcgcaccgggcacatcgatcttgttcacggccacgacgatcggcacatgggccgactgcgcgtggttgatggcttcgacggtctgcggcatcacgccgtcgtcggcagccaccacgaggatcgcgatgtcggtgagttccgcgccacgggcacgcatggcggtgaaggcctcgtggcccggggtgtcgaggaacgtgatcttgcgttcctcaccctcgagatccacggtgacctggtatgcaccgatgcgctgcgtgatgccgccggcctcacgggcgacgacgttggtgcggcggatcgtgtcgagcagtcgggtcttaccgtggtcgacgtggcccatgacggtgaccaccggaggacgcggcttcaggtcggcctcctcctgcagctcctcgctctcgaggtcgatgtcgaactgctggagcagctccttgtcttcctcttcggcggaaacgatcttgatgttccaaccgatttcctcgccaaggatctggaacgtggattcgtcgagtgactgggtggccgtggccatctcacccaagtggaacagcacggtgaccagcgccgccggattcacgttgattttctcggcgagatccgccagcgaggcgccctgacgcagacggatggtctgtccgttgccggtggggatgcgcacaccgccgatgaccggtgctttcagctcttcgtattcgtgacgcttcgccaaacggttcttgcgagccttcgaggacttgccgccctgacggccgaaggcgccggctgcgccgccgcgaccacggccgccaccgcgcgatggaccgttgctgggaccattgttctggaagttgttgccgccgttgccaccaccgaaacggttaccacccgggcggccgccaccgctgcctgcaccctgacgatgctgaccccaggaacccggcttcggggcaccgctgccgccttggcccggacgtgggcggaagcctccacgctgacccggtcgaccattgcctccgccacggcgttcgttgttattgaccgtcggacgtgccatcggatgcggacgcgggatgtctcccggcgtgggtgtgtgcatgccctgcttacggctgaacgggttgttgcccggacgtggcgcatgctgggccgcattggctcccggcttcggcgcattgttggaaccgccgcggttgccgccgtgctgaggggcatgcggagtgggtgcagccttgcctccgttgcgagtgccaccggcgttggcgcccggcttgcctggggcgtgcgggcgcgcagtcgcaccacgctggccgccgttctggcctggacgtggggtctgctcgttcctgcgggtgttatgggcgcccggcttggcgctcgtgttggagcgctggcccggcttcggtgcggacggggctgccgttgccggagttgcaccggccactgcggcgggcgtcgcggcaggcttcgccgctgctggtgcacccgacttgggtgtggagctcttcttcgccgacggcctggaatcattgccgccgtccttcgggaaggccgccttcagcctgcggacgaccggggcctccaccgtggatgacgcggatttgacaaactcgcccatgtccttgagcttctcaagaacggtcttgctgtctacgccaagttccttggccaattcgtatacgcgtgctttcgccactcaatatctcctaaagttttgtgtgtgtcagccgcgtattggcgcggctattgtgttctcacggcgagctgatggcttctcatcgtgcaaccatgttgtttctacctctttcacgccttcgcacggtgcaatgaccgtgtttcgaccaaaggcaagcatacccgcggcgctggatgtgcagcgccgcgaaaacgccgtcggggaaacgcctattcggcgctctcctcggcattgccggactgtgtcccatcggccgccttcgccgcctgttcacgcagttttgcggcatgggcggaattggattcgatgccgatcttccatccggtgagctttgcggcgagacgggcgttctgaccctccttgccaatggcgagcgagagctgctcgtcattgatgaacgcgatggccgtctggttcttctcgctgatcacctgcacatccgagaccactgccggcgagagcgccgccgcaatgaactcggccggattggccgaccagtcgatgatgtcgatcttctcagagccgaggttctccatcaccgcgcgcacacgcgaaccacctggaccgatgagcgcgcccttcgggttgatgcctggcgtattggcacgcacggcaatcttcgtacgggcgcccgcctcgcgggcgatggccatgatcgacacggctccggatgccagctcgggcacctcgcgttcgaacaggcggcgcacgagctccggatgcgaacgggagacgatgatctccggtcccttgagcccgcgggccaccgtcgtcacatacacgcgaatgcgttcgccatggcggtagcgttcgccgggcacctgctcacgacgcggcagcagtgcctccacatcgccgacggcaacgtgcacattggcgggatccttgacgtcctgctgcaccacgccggtgatgagcttgccgcgctggccgctgaaggcgccgaacacgcggtcgtcctccgccttgcggaagagctgctggattacctggcgtgccgtggatgccgccagacggccgaaatcatgcggggtgtcatcgtactcctcgcccagttccggagcggggtgcggattgtcttcggtgggttcctgaggaatctcgtcacgagcccagatggtgaagctgccggcgcgcgggtcgagttcgactcgggcatattttgcggcatgcggcattttcaaataggcgagtcgcagcgcctccgacagtgcggcatccacggtctccgcatctattccctgttcctgtgcgagtgcgtggattccgttcaaatcgagtttcaaagttggtgacctccgttgaagtctgttcagttattcagttattcggcatggcgcattcctgcgcggaaggcataagcccatttagtcatagtctctattattctaggtattcatgcagacacgtcaccgtttcctttccgtatgcgcacgcacggtggcggttgccctcaccacgctcgcatttgttggcgtgaccgcatgctcggcccccagaatcgcaggtcgctccgaacaggagcaggagctcggcacatgtgaacggttcctcgagaccgcgcaatcgtattccaacacgatgggcgacgcgaatatcccgctctatctgcggtatttcaccgcttcactcgcccagcatgactggctcaatgtggcattgcagtgcccgtcccaattcggcgacgccacgatgcgcagcgcccaggcacagcatttcactcgtcttgccgcgaatcacttcggttttgcgtatgcgccgctcacagtgacgaagctcgacaccgtcgattcgcttgatctgccgggtgaggcgctggctacgattgcgcttgccgaggatcgcgccggtttcgccgccgaagtgctcgccggacgctacgacagtttcacacccacttccgccaacacctcctccgacgccgaattcgtgcgcagactggcctcgaatgccacgctgctcaccatgagcgacaatcacaaggaggccgcagcacgcctgaccatgctgtcgaaaggcgcgcaggacattcgccgcaaggtctacgacacccgcatgctcaccacatcggaggtgaacgcaaccgatcctgcgaccggattgcgcacccgcaccccggcgattgtcgaaatggattgcgcgcgcgagcaactgcagcgcatcgacgacctgcccgcatccgacatcgccaccgcacagtcgcaatcgtcggacgcgctactgcagctgtccctgctcatcgccacgcatgccgtcaccgcgttcggtctggggtacccaagcgctgactatgcgctgttcgcctcctgaacaaggcctgtgcagtgacatgcggaaaacgacataccggatttgacttgttggcacggtgtggcataatgaacaagttgcttgtttcggcaagtacatggatgagtgtccgagcggtctaaggagcacgcctcgaaagcgtgtgagggcaaccccctccgcgagttcgaatctcgcctcatccgccttcagcccgcaccttgccgcgggctttttctttccctgcctgcctatcgtgcaccatcaacagcctgcgtaaaaggagacactcacacgcagcagacgtccccaattacgcagaggaatagggccgagaagcacaacgacgcgcgaaaccggcacgattattcggattcaatgtcggtgcctcagcattcgctagagcgtgcgcttggcacggattcgttccgcacgcgcggcgagctcgtcgtcggccggataggcgatgtgttcgagcgtgagcccctggggcgcgatcggcccagtggatccctcgcgcaacggcacacgcatcttgccggcgaaccaatccacatcccgtttgcccatgcccacctgcacgcaggcacccacaagcgagcgaaccatgttgcgggcgaaggcgtcggcgacgattgtgaagcacagcagcccggactccacggcaggcgtatggtagcgctcccccatgccgggtccgagcaacggccgcgtcggcacgcgttgccagtaggcggtcttcacctcgcgaatagtcgtgccccccggattcgcaatggcgaacgaaccgaagtcatgcagccccagtgtaagtgcggcagcggcattcatctgcgcgatgtcgagttcgcggtcggtgcgccatgcgaaatccttgagccgcgggtcccagggcacgcgcgcgtcggcaatccggtacacataggtgcgttcgagtgcggagaaccgcgcgtcgaaaccggcaggcgccacggaaatcccatggatggcgatatcatcgggcatcatgcgcgacaacctggtctgcagggcctgcaccggcgtcaaattcatatggccgacgcattgtccgagtgtctggtcgggaacatcgacgtggcacacctgatgcgtggcatgcacgccggcgtcggtgcgcccggccacggtgagccgcaaggacccggcatccggcatgcgcgtgattcttctcaaggcctcctcgacggttccctgcaccgtccggcagcctggttgcgccgcccatccgtggaacgcggcaccgttataggccaagtcgattcgtaaacgtgtcacaacccgagcttagcaaatgcgcaccgatgtccggcgaggtctgtttccatatgcaaaaggggccacccaaacggatggccccttcctcatgcctcagaggttcactcagcggctgcctcggtctgctcttccttggctgcgaccttggtcgcggcttcggcttccttgaccactgccttcttcgggctcaccggttcggtgacgagctcgatgatggcggctggagcggaatcgcccttacgcggagcgatcttgacgatgcgggtgtagccgccttcgcgctgctccatctgctcagctatctgcgtgaacagcttgtgcacgacggacttgttacgaatcacgcgcatcacacggcgacgggagtgcagatcaccgcgcttggcgaaggtgatcaggcgctcggccagcggacgaaggcgcttggccttcggcagcgtggtggtgatgcggccgtgctcgaacaggctggtggccatgttcgcgagcatcagacgctcatgtgccgggctggacgccaggcgtgggcctttctttggtgtaggcattgtatctccttgttgccacgccgaactcaggtgggcagtggcccgaacatccgaaatcggcgaagcggttatgtcgttggcggtttactcgtcttccggcgagaagaaggtgccgccttcgaggttgttggtgtcgaagccgagcggcgaggacttgagcgacagacccagggactgcagcttctccttcacctcgtcaatggacttcataccgaaattacggatgtcgagcagatcctgctccgtgtggttcaccagctcgccgaccgtgtggatgccctcacgcttcaggcagttgtagctgcgctgggtgaggttgagatcctcgatcggaacggacatgcccggatcggcctgctcggccaccggggctggcccgatttccacaccctcggcctgcgtgttgagttcacggcacaggccgaagagctcaaccagcgtggatcctgcggatgcgacggcatcacgcggggagatggccggcttggtttccacatccagaatgagcttgtcgaagtcggtgcgctgttcaacacgggtggcttcgaccttgtagctcaccttgagcactggagagtagatggaatcgaccgggatgcggccaatctcatcgccatcctgcttgttcatctgggctgggacgtatccgcggccacgctcgacggtgaactcgatctcaagttcgccatcttcggcgagagtggcgatgtgcagatccgggttggcaatggtgacaccggccggtggggtgatgtcccctgcggtggcctcgccgctgcccgccttgcgcagatacatcacgacaggctcatcgtattcgctggtgagcacgatgcccttgatgttcaacaagatctcggtgacgtcttcctcgatgcccggcagagtggtgaactcatgcaacgcaccggaaatacgcaccgaagtcactgccgctcccggaatcgagctgagcagagtacggcgaagcgagttgccaagcgtgtagccgaaacccggctcaagcggctcgatgatgaaacgggaacgctgagggttgagcgattcctcggtaagtgtcggacgctgtgcgataagcactgtggtatcctttcagcttcagccggtggtgcactcactggcttcaagcggctttggatggatggtattgtctagtgctcagacgcggcgacgctttggtgggcgaacgccgttgaatgcctgtggagtgacgtcggtgatcgaaccgacttcgagaccagcggactgcagggagcggatggcggtttcacgaccggaacccgggcccttcacgaaaacatcgaccttcttgacgccgtgttccatggccttgcgggccgcggactcggctgccatgccagcggcgtacggcgtggacttacgggagcccttgaaaccgacatcgccaccggacgcccaggacacaaccgcgccggacggatcggtgatggagatgatggtgttgttaaacgttgacttgatgtgcgcctgaccgaccgggatcgacttgcgatcgcggcgacgggtcttgcgtgcggcctgcttttgagctgccatttgacctcgtttcctaattcacgaactatgtgttgcagacgatggctgtcacaccgtggcctgcaattcccacctattacttggtggccttcttcttgccagcgaccgtgcgcttcgggcccttgcgggtgcgtgcgttggtcttcgtgcgctgaccgcggaccggcaggcccttgcggtggcgcatgccctggtagctgttgatctggatcttgcggcgaatgtcagcgtcgacttcacgacgcagatcgccttcgatcttatagttcgactcgaggtagtcacgcagcgtgatcagctgctcatccgtcaggtccttgacgcgggtgtctggattgatgccagtcgcctcaagggtttccttggcgcgggtgcgtcccacaccgaagatataggtgagcgcgacctcgatgcgcttgtcatttgggatgtcgactccggcaagacgtgccattgcgattccttctgtttgccgcaggtctcgcacccgatcccccggtatccctaccggcccgggcctgcgttcccggggttcagctcacgcatacacgcgaactgcgactgagtgcctgatatgtgtcgctgcttctgctcagccctgacgctgcttgtggcgtgggttggtgcagatcaccatgacgcgaccgtgacgacggatcacgcggcagttttcgcagatcctcttcacacttgggctaaccttcatggtattcctttgcttgggtttgtaccttggctgttactttacttgtaacggtacgtaatgcgaccacgattgaggtcgtatgggctcatctcgagcaccacacggtcctgcggaagaatacgaatgtagttcttgcgcattttgccggaaattgtggcgagcacgatgtgcttattctccagttccacacggaacatcgcattgggcagagcctctacgactcggccttcaacttcaatcacaccgtcttttgccataaatacccgttttcctcgtggatagcattacctgtaggtgcgccagaagacacaccaacttgctagtatacacgaaaagcgaagagtgcacgcaacggcgtgtcgtacccttcgcttccgtaacggaccgggcgaacactttgtgcccggttcaatggcgtaccgtcttctatgctaccgaattgagacgcggattattccatgttcaccaatcccacacacctcacggcacgcatttgcaccattgttcagccaagcttggcatcgagtgccttgacgatctcctcgctgatcgcatcgatctcgcccacgccgttcacggtgacgagcttgccgcgctgctggtagatgtcgagcaccggcgtggtctccttgtcgtaggtgttcagacggttctggatcgcctccggggtgtcgtcggcacgcccctcctccttcgcgcgcttggccatgcgctcaagcagcacattggtgggggcggtcagcgcgacaacggcgtcgagctgctcgccgaggccctcgagaatctcgtcgagcgcgctcacctgggcgacattgcgtgggtagccatcgaggatccagccattcttcgcatcatcctgcgcaagacgatcgcggacgatctcgttggtgagctcgtcggggaccaggaatccctgcgacgtgtattcaagcaccttcttgcccagttccgtcttgttcttgatgttcgcgcggaagatgtctccggtggagatcgtcggaatgccgtagtgctcggcgagcagcttcgcctgtgtgcccttgccgacgccctgaggtcccataatcagcagtcgcatcgtgttcctttcgcttgggatttgctttgctatcgcatatcttagcctagtgtgctcacggcaggagtatcggcatgccgcggcgagccatgcatatgcaaaagcagaccgtagattcccacggtctgcttttgcggcaatctgcgaatggcagattattcacacctgcacatcatttggcgatggccttgccctcggtgtgatcggtgttctcgaacaggaagcctgcgtactggtactgctccgtctgcgccttcgcctgacgcagcgtgtcgagacccacgccggcgatgatcagcagcgtcgtgccaccgaacggcagctgcgtgttgagtttgagcgccatgatgagcacggtcggcagcaatgcgacgaacagcaggtagatcgcgccgacggtgttgagtcggttgatcacgtacttgaggtagcgcgaggtggcggagcctgcgcgaatgcccgggataaagccaccgaactgcttcatgttgtctgcggtctcgtctgggttgaacgtgatctccgtgtagaagaacgtgaagaacacaatcatcagcgcatacaggcagatgtaccacacgctcgtcgtgttggcgaggtacttgttcacccactgcacccagctctgctggctgttgccaaactgtgcgaacaatgtcgggatcgcgaggatcgacgaggcgaagatcggcgggatcacgccgctcatgttgatcttgagcggcaggtaggtggaggagccgccatacatcttgcggccgatcatgcggcgcgtgtattgcaccggaatacggcgctgcgagagctccacgtagttcacgaagatcatgatcacaagcagcacgacggtgacgatcgcgaacttcgtccaattgccgtcggtgccgttcgtgccccagccgatctgccacagctgcggcaggaagcccgagcagatggacaggaagatgaggatcgacatgccctggccgatgcccttctcggtgatcaattcggccatccacatgatcaggccggtgccgccggtcatcaccatgatcatgacgaccatgttccaaatggaggcgtcggggatcacattgttgcactggtagttgaacagcgcgccggaacgcgcggtgacgaggattgtcgtggactgcagcacggcgagaccgatggtaaggtaacgcgtgtactgggtgagcttggcctcaccggactgcccctccttgtgcagggcctcgaagcgcgggatcacggcgcgcagcagctgcaccacgatcgatgcggtgatgtacggcatgacgcccaatgcgaagatggacagctgcagcattgcaccgcccgagaacaggttcaccagtccgatgaagttctccgcattgttggtcgtattcgccacgcagtcgttcacgaccttgtaatcgacacccggcgttggaatgaacgagccgattcggtagatgatgatgatgccaaggacgaagaggatcttgttcctcagctccttggtgcgaaaggcctggattaacgtcctcaccttgggttccctccataactgtacgctcttggcgtatcacgaaaaacacacgctaaagttcgagtctagcccaacggccataccgcacgcgagttcccgcctcttttttgcaataattcaacacaaattacagcggccatttcctgttttgatatttcgcgcgcatgttctgcacatatgaacagaccctccccgcttgctgcgggaagggtctgtcgctagcgtgtatgcatgccgtcagtcttcgctgatcgaaccgcctgccgcttcaatcttggacttcgccgaagcggaggccttgacacccttgagggtgaatgcggcggtggcttcgccctcaccgaggaccttgaccggacggttggcacgcactgcgcccttggccaccaggtcagccacggtgatctctccgccctgcgggaacagatcgttgagagcagcaatgttcacaacctgatattcggtcttgaacgggctgcggaagccgcggagcttgggaagacgcatgtacagtggcagctggccgccttcgaagccaggacgaacctgatagcgcttcttggtgcccttgtcgccacggcccgaggtcttgcccttggagccttcaccacggccgacgcggatgcgatccttcctggcgcctggtgccggcttgaggtcatgcatttgcaggattgtggtctcttcgttagccataatcactctgcctcctcaacattgaccaagtgacgcacgacggcgatcatgccgcgggtcgacgagttgtcttcaagaacagtgctctggccgatcttgcgaagggcgagcgtctgcacggtagccttctgcttcttgttcgcgtgtgcaacaccgtgcacgagcgtgatcttcagctttgccatcactcaccatccttagcggccgcttcggccttggcttcctcgcgtgcctttcgggcctcggcaatgccggcggcgcgctcacgcaggagctggtccggagcgacttcctgcacggagaggccgcggcgtgccgcaatctcctccggctcttcgagctgcttcagcgcatcgacggtggcgcgaaccacgttgacggccgttgcggagcccatcgacttcgtcaggatgtcggtgatgcccgcgcattccatcactgcacgcacagccgagccggcgattacaccggtgcctggagctgccgggcgcagcatgacggtgcctgcgtggtcgtggccggtgaccgggtgggtcacggtgccgcgaatgcgaggaacgttgaacagatgcttcttggcatccagctgacccttggcgattgccgccgggacctcacgggacttgccatagccaacaccgacggtaccgttgccgtcaccgaccacgacgagagcggcgaagctgaacgtacggccgcccttgtgggtcttcgacacacggttgatcgtcacgacgcgatcgagcatctcgttctcgtgattgtcctcacgacggccacggcggtcaccgcggcgaccttcgccaccacggttgttgcggcggccacgacgctcgtcgttgttgctggactcggcggttgcctgagtgttctgagtctcttcagccacttgggtttccttttcgttgtcgctcacagtgccagacctccctcgcgggcgccttcagcaacagctgcgacgcgaccatggtacatgttgccgccgcggtcgaacacgaccgtggtgatgccggcatccttggccttcttggccaggagctcgccaaccttcttggcggcttcggtcttggtgccctggaagtcggcgaaatcggccataagcgtggactcgctcaccagcgtcttgccggcgttgtcgtcaacgatctgcgcgaccatgtgacggttggagcgggtgaccacgagacgcggacgctctgcggtgccgctgatgcgcttgcgaatacgagcgtggcgacgcttcagcgcggccttcttgcctttaccgaaaatcttaacgctcatatcacttaccagcctttccagccttgcgacggatgacctcatccgagtacttgatgcccttgcccttgtacggttccggagcacgaagcttacgaatgttcgcggcaacctggccaacggcctgcttgtcggtacccttcacgatgacctggttcgggttcggcagttcgagggtgatgccttccggcgggttcacggtgatggtgtgggagtaaccgagcgagaactcgatgcccttgcccttcatctgtgcacggtaaccggtgccgacgatgtcgaggctcttcgaatagccatcatgcacgcccttgaccatggaggccacgatcgaacgggccaggccgtgctttgcgcgggtcggacgcaggtcgtcgttcgcggtgacgatgatctcgttgccttcgaccttggcggtcacgccctcggggatggtgtaggagtcggaacccttcgcgcccttggcggcgaattcctgaccattgatggtgacttcaacgcccgccggaatctcgatcgggagcttaccaatatgcgatgccatgttcagctctcctttctcaccacacgtaggcgacgatctcgccaccgatgcctcggtcgaggcattccttctgagtcaacaatcccgagctcgtcgagatgatggcgatgccgaggccgccgagcggcatgggcagtgcgtcggacttggcgtaacgacgcaggcctggcttcgacacgcgcttgatgccctgaatggaacgctcaccgtgggggccgtacttgagggtgacctcaagggtctggccgacgcgggcttccttggcggtgaagtctgcaatgtagccttcgcgcttcaggatctcggcgatgttcttcttgaacttggagtacggcatatccacggtctcgtgctttgccgcgctcgcattacgcagacgcgtgagcatatctgcgattggatctgtcattgtcatttgggctaacgccctttctcgccgtggtttccgccgccctgcagactgctatggcctgcccgggccgcggaccttcagcgttgatatttaccaactggacttcgttacgcctggcagctcgccacggtgtgccttctcgcgaaggcagattcggcacaggccgaacttacggtacacggagtgcggacgaccgcagaccatgcagcgcgtgtaggcgcgaaccttgaacttaggcttgcgaagcgccttgaccttaagacaagtttttgccatttcagttctccttgaatgggaagccgagaagcttgagcagtgcgtaagcctcgtcgtcatccttcgtggtggtcaccacggtgatgtccatgccgcgctggtgatcgatctcatcaggatcgatctcgtggaacatggactgctcagtgagaccgaagttgtagttgccctgaccatcgaactgatggccgttgatgccacggaaatcgcgaatacgcggcagggccagcgtaagcagacgatccaggaactcccacatgcggtcaccgcgcagggtgacgtatgcgccgatggcctggccttcgcgcaggtggaactgtgcgacggacttcttcgccttggtgatcttcggcttctggccggtgatcgcggtgaggtcacgcacagcgccttcgatgagcttggagtcgcgcgctgcggcgccgacgcccatggagacgaccaccttctcgatgcgaggaatctgcatcgggttgtcgtggtggaattccttctcgagctcgggaaggatctcttccttgtacatcgtcttgaggcgtggggtcactggctcttcgatgatgacttcgtcaacgacttcgctcatgccagttcctttccggacttcttggcaacgcggacgcgcacggtcttcaccttgccgtcacgtgcctcttccttgattacgacgccaacgcgggtgggctgcttggtctccgggtcgatgaccatcacgttggagcgatggatcggggcctcaacggagacgatgccggcctgctgaccctgctgggttgcacgcacatgcttcttgacgatctgaacgccttcgacaatcagtcggtcatccttgagaacgcgcttgacggtgccttccttgccgcggtccttgccacggatgaccttgacgaggtcgccgctcttgatcttggctaccatgtcagatcacctccggtgcgagggacacgatacgcatgaagcgcttgtcgcgcagttcacgaccaaccggtccgaagatacgagtgcccttgggttcacggccggagccgagaatcacagcggcgttctcgtcgaacttgatgtaggagccgtctgcacggcggcgttccttgactgtacggacgacgacggccttgaccacgtcgcccttcttgaccgacccgccagggattgcgtccttgacggaggcgacgatcacgtcgccgatgccggcatagcgtcgcttcgatccgccgagcactcggatggcgaggagttccttcgcacccgtgttgtcggcgacatgaagccgcgtttcctgctgaatcattgattctccttagccgagctggttctccccaatcacccggcccgctcctatgggcgagccgggtgattggcgagccttgccgaacttgttacttagcgcgctcgataatggaatcgagacgccaacgcttggtcttgctcagtggacgagtctccatgatactcacgaggtcgccaacgtgagcctggttgttctcgtcatgggccttgaccgtgcgagtggaacgaacgaccttaccgtagagcgggtgggtcgtacgaagttcgagttccacggaaatggtcttgtccatcttgtcggacacgacataaccgcgacgaactttgcggaagttacgctcttcagccattacttctccttaagctttcgtttcggttgccgccggagcctggctgatgccaagttcacgttcgcgcagaacagtatacatcctggcgatgtcacgcttgacagccttgaggcgagcagtgttctcgagctgaccggttgcatgctggaagcgcaggttgaacagctcttccttggacttcttgatgaagccctcgatctcagcattggtcttctcgttgagattcttgatggtgtattcttccgatccgactggcatcagatgtcaccgccttcgcgagcgatcacgcggcacttcattggaagcttgtcgattgcgcggcgcagggcctcgcgagcgacatcctcagaaacgccaccgatttcgaacatgacacggcccgggtgcacattggcaatccagaattccggagtgcccttgccggagcccattcgggcgccgagcgggtgcttggtgagaggacgatccgggaagatcgtgatccacaccttgccgccacgcttgatgtaacgggtcattgcgatacgagcagcctcgatctggcggttcgtgacataggccggagccaatgcctgaatagcgaaatcgccgaagttgatctcgttgccgcccttggacatgccatggcggtcaggacgatgctgcttgcgatatttggtcctctttgggataagcatcctcagctcactccttagtttccggctctacggcagcttccttggaaacttccgcttccatctgctgatccggacctgtcttgacctggttctgaccggtgggacgctggccggcacgctggccacggcgcggacgacgatcgccgccgcgacggcccgggcggttgttgccctgctgtgcctgctgctcctcgaactcacgctcggtcatatcgcccttgtagatccacaccttgacaccgatgcggccgtaggtggtcttggcctcgaagaagccatagtcgatgagagcgcggagcgtctgcagcgggacgcggccttcacggtagaactccgaacggctcatttccgcaccgccgagacggccggagagcttgatacgaatacccttggcgcctgcacgcatggcatcctgctgagccttacgcatcgcgcgacggaaggtcacgcggttggtgagctgctcggcgatgccctgagcgacgagctgggcgtcgatggccgggttcttcacttcgaagatgttgagctgaacctgcttgccggtgagcttctcgagcttggcacgaacacgctcggcttcggcgccacgacggccgatcacgatgcccggacgggcggtgtggatgtccacacgcacgcggtcgcgggtgcgctcgatgatgatgcgggacacgcccgcacgctcgagatccttgttcatgaccttgcggatggcgtcatcttcgaggacgaagtcacgataacgctcgccgaccttgttggaatcggagaaccacttggaacgatggctctcagtaatgcccaggcgatagccaaagggattaatcttctgacccatctttagcggtctccttccttgctagcgacgacgaccgtgatgtggctcgtacgcttgttgatacgagcggcacggccctgtgcacgagcgcggaaacgcttgagcgtcacaccctcgtccacataggtctccttgatgtacaggtcgttctcacggaacggctcgccggccttgtcggccttcacgcgggcgttcgcgatggcactctggaggaccttgagcaccggggtgctggcgtcctgcggagcgaacttgagaatggtgatggcttcggtcgctttcttgcctcggatgaggtcgaccatgcggcgagccttacgcggcgtcacacgaacgtggcgagcgattgctttagcttccatgtgtctatactctcctacttattagcggcgcgacttcttgtcgtccttgacgtgacccttgaaggtacgcgtaggggcgaactcaccgagcttgtggccgaccatggattcggtgacgaacaccggcacatgcttgcgaccatcgtgaaccgcgaaggtgtgtccgatgaaatcaggggtgatcatcgaacggcgggaccacgtcttgatgacgttgtgggtgcccttcgcattctgctcgtcgactttcttctgcaagtgggcgtcgacgaatgggcccttcttgatgctacgagtcatctactcgacactcccttacttgcgattcttgccgttaggacgacgacgaacgatcatcttgttcgaagccttcttcggacgacgggtacgaacctcgcccttgccccatggagacaccggcggcttgccaccgcgggtacggccgccatgcgggtgatcgacagggttcatggactcaccacgggtgatcgggcgcttgcccatccaacgtgcacgacctgccttgccgagctggatgttggcgtggtcggagttgccgacctcgcccacggttgcgcggcagcgggcgtccacgttgcggatttcgcccgatggcatacgcagctgggcgtaagcgccatccttggcgacgagctgcacggccgcaccggcggaacgtgcaatcttggcaccgccgagcgggcggagctcaatggcgtggacaaccgtaccagtcgggatgttgcgcagcggcaggttgttgcccggcttgatgtcggcgttggcgccggtctcgatgcggtcaccctgcttgatgccctcaggtgcgatgatgtagcgcttctcaccgtctgcgtagtgcagcagggcgatgcgtgcggagcggttcggatcgtactcgatctgagccacggttgccggcacgccgtccttgtcccaacgacggaagtcgatgaggcggtactggcgcttgtgaccgccgccacgatggcgggaggtcatgcggccgtagttgttgcggccgccagttttgctgttcttgcgaatgagcgacttctctggggtcgagcgcgtgaggtcggagaagtccgaaacagacgcgttacgacggcccggggtcgtcggcttatatacgcggatagccataatctagttctttcctttaacttttctcggctaaccttcagttaccgaagatgtcgatcgactggccctcggccacggtcacgattgcgcgcttctgattgacgcggcggccgtaaccggtgcgggtgcgcgtgcgcttgcctgcacggttgagggtgttgacgttcgtcaccttgaccttgaagatctcctcgatggcctgcttgatctgcaccttgttggcgttcggggccacgacgaaggtgtactgacccatatcggacagagcgtagctcttctccgaaacaacaggcttcaggatgatgtcatgtgctggcttgtgaatagcgaccatgaactcaggcctccttagctgccgtcttcgcggcgacgaaagcctcgagaccatccttcgagaacaccacgtactgggcggtgatcacgtcgtaggtgttgagctgatcggcgaagatcgggtagacggtcggaatgttacgaaccgacagccactcgttcacgttgtcgcgggacagcaccacggtggtgaagttgtcggcgacgaccggggcgagagccgcgattgccttcttggtggacggtgcgtcgagctggaagtcgacgactgcgacgcgaccgttgttggcgcgatccgagagggcgtagcgcagggctgcggccttcattttcttgggggtgcgctggctgtagtcacgcggcaccgggccgtgtgcgacaccgccgtggtaccactgaggagcgcggattgagccctgacgagcgcgaccggtgcccttctgcttccacggcttgcggccaccaccggagacggcgccgcggttcttgaccgcatgcgtgccctggcgggcggctgcacgctgggccaccacaacctggtggatcagcggcacgtgtgcctgcacttcctcggcggtgaagccgaagagcgcttccggcgcctcgagggtgccggcttccttgccattgttatcggtgacgttcagagtaacgtttgccatctaaatcaggctcccttcactgcagaacgaacgaggacgatgccgcccttcgggcccgggatggcgcccttgatggcgaggatgccgttctccacatcggaggagacgacagtgaggttctgcacggtattggtgacatggcccatacgaccggccatgcgcttgcccttgagaatacggctcggcgttgcgcatgcgccaaccgaacctggacgacgctcgttcttgtgagagccgtgggtacgacggtaggacttgaagccccagcgcttgatggtgcccgcgaagcccttgcccttggtggtgccggtcacgtcgacctgcacaccctcagggaagacctcggcggtcagctcctggccgggctcgaaatcctctacgttctcggtgcgaacttcggcgaggtgacgacgaggcgtcacaccggccttggcgaaatgaccggccatcggcttggtcaccttacgcgggtcgacctggccgtagccaagctggacggccttgtagccgtcggtctcctcgttcttcacagccgtgacgacgttggtcgagacctcgacgagcgtgacgggaacgaagaagccgttttcgtcccaaacctgcgacatgccgagcttcttgcccagcagtgcgttgcgattcttgttctgcgacattgcggttcctcctccccttacagcttgatctcgatgttgacgtctgcgggcagatcaatatgcatgagggagtccacagcctttggggttgggtccacaatatcgatgagacgcttgtgagtgcgcatctcgaaatgctcgcgagaatccttgtacttgtgaggggaacgaataacgcagtagacgttcttctcagtcgggagcggaaccgggccaaccacagttgcacccgcgttcgtcaccgtttcgacgatcttcttcgccgattggtcgatgacctcatggtcataggacttaagcctgatgcggattttctgtcccgccattgccttccgccctttctagcgattcgtgtatcaatgtgacttaacctgctccagggcaccggcgagtgaagtctttgggcaaacgtccgccgacttttcctacatcagtgcgcagccatgcaaaaacccgtgcgggcttttgtgccgcgctcgcttttttgattccaattatgcgagccctaatcaggcaacttctatatttaagcaccgggggtggtcttttcttccgctggcggcgatggcgtgtcgcattcaccctgacgtcttcacagtcccgtcacggaatgagcaccgtagcggcataggtgatcatcacgaaagagaccaagctcgtcacgcactcgcctattcccgcgatcttcgcagtcttcctcatattgcgcgtcgcgaccggcatgacgacggcgcgcgcgagcagaatcgcccccaaccagccatagatcggactgtataggaatccgatggccatgacgagaatgtgccagatccacgaggcagcgagataccgggtattcccctgttcgcgaatcatcgtcttcacatagagcacactgccgaacagcgtgagcgcgtacgcgcccgcgatctccacgccaagcggcggcaatatgctctggccgaacggcagaagatgcgcaagggcgggggcgtccccaccatgcgtgccgagcgaagcgacgggaatcgccatggtactggaggcgagcactgcacagatattcgccggaatcgaatgctcacggcgtcgccatgcacaaattagcgaccccgcgcacagcacgcagtagatcggagcccaccatagcatgccggggaatctgaacacgaacggcaatccggcgcagacgagcagcgcggcatagacgagcatcggcatgcgataccgtgcgcgcccatgcgatttcgcccatcgtgcagcactgaactgcacgcagtagcacaggcaccacaatacgagcagccacacggagttccatgtgggaccggagacgaggaaggcgctgagcgcgggcatgagcacgatcacccatgcgccgggttcattcgaacgccaatcgcgcacggatcgcgtagagattgaggagatcatgctgccctagcctacgcgagtgtcccaagacatgccagagcgaattcacgccgtcaacaaaccacaatgccgctgccggctggcgctgcatgcacgcgcggcttaccgtcggattatgagaagtagcagggaatgaccgagctcgattgcgaggcccgtcggcagcaacgctgcatctgcgcatccgattcccgtcaggcgaagatgctggcgcggcgatgcgcaggcggcgaactcgtgcgcgtatatcggggcatgtacgcacacgcgcaattctggcgcacgctgcctcctcccgtgcaaatcgtgtatctggcacgcgcgctggcgaaaagccatcctgattgggtgttcaacggagagacagcggcctgcgtgcggaatctacaaattccatggcatgcattgactcaccgcgtgaccatcgcctgcaccgcgggtccgcagaaatctgacggcccgcgtctgcaacgcatccgccacccgaatatgcgcgccgaaataatcgacggtattcccgtgacgccgcttgtctgcaccgcgtcggactgtgtgctcacgatggagccgtgcgcggcgatcacagcgttggacggctgcttcaagacggggctctccacgcgcgagctgctccgggaatgtgctgcgaatggcacggatgcagtggtcaccctgctgccacatgtcaatccggccagcgagaacggcggtgaagcctatgcgcacgcagtgatgaccgcgcgatatggtttcaggaagccgcaacagcaagtaccactcaccgatccgcaaacagggcacatataccgcgccgattattactgggtttgcgacgacggaacggtgattgtcgcggaactggacggcgcgcagaaatatattgatccgcagatgacgggcagtcgaagcgtgcacgccgtcgtggctgacgaacgagagcgggagaaggcgctcgagagggcaggcgtgcacagaaccgtgcgcttcacgttcgacgatgtgattcacagcgagcgattgcatgcgaaactgcacagcgccggcgtacccacccactttcttggatcgacagacatcaatgggtatcgggtggcaatcattgggtgagcggaacgcagattggaagaaaatatgcgcgtatggtttttcttcccagttacggcatagctcgcgggaagaaaaacattgcttctatatttccttcccgctaggaactgccaaacgagaagaaaaaccacggattcctttttcttctcatctgggctctcgctcgcgggaagaaaacatgcgcgcgcggtttttcctcccatttgcagattccatattgcacagaacccagattgctgacatcagaatgggccacccgactggcggatggcccattggcaatggattgcatatagattgcaatggattggcggatcagacgcgctcggaggcttcctccgtggcgcccacgccttcgcgctcaacgcgcatcgcatggccctccgcctgcgagacgccgtagtaggcggcgatggcgatatccatcatgtcctggatctgcgggatgcgcggattcgcaggcgcgcactggtcttcataggcgcgcatgccgatctgctcgaggatgctccagaagtagtcctcatccacaccgcaatccttgaagctcttgttcatgccgagcttattgtcgcggtagtcctcgacggccttcgccagattctcgacaccctcggccggggtcttgcctgggtcgaccccgagcagcgaggcgagctcctggtaacgctccggcgcgatgtacttgctgtacttcggccaggaggtcggctcctccggcacctgcccgttgtagcggatcacatatggcagcagaatcgagttcgtgcggccgtgcgcgatgtggcacagggcgccgatggtgtgcgccatggcgtggcacataccgaggaaggcggatccgaatgccatgccggccatggtggcggcgttgtgcatcttctcctgcgccttcttcttggtttcgcccggctcgctattgacggactccgcaaggttgtcccagatcagcttgcaggcatgcagcgccataccgtcggtgaagtcgttcgcatagacggagacgtaggcctccatcgaatgggtcagcgcatcgaagccggcatcggaggccagtcggcgcggctgcgtgcgcgcgagcaccgggtcgacgatcgcgacggacggcgtgagcgcgtagtcggtgatcgggtacttgtagccggtcttgtggtcggtgatcacagcgaacggcgtgacctcggagccggtgcccgacgaggtcgggatgcacacaagcttggccttggtgccgagcggcggaatcttgaaagcgcgcttgcgaatgtcgaagaacttctcacgcacgtcggagaacgcgatttccgggtgctcatagagcagccacatgatcttcgcggcgtccatgggagagccaccgccgacggcgatgatcgtgtccggctcgaattcgtcgcgcatcatggcggcgccgcgctcgacggtctcgacactcggctcgggctccacatagtcgacgatgcggaaggtgactcggttggagcgtgcacgcagctggtcaatcaccttgtcgacgatgccgagctgctccatcaccttgtcacacacgatgacggcacgctcgatgccatacatgtcgcgcaggtacttgatggcgttcggctcgaagtacgtctttgccgggatcttgaaccactgcatgttgttgttccttcgcgcgattcgcttgatgttgagcagattgatcgcctgcacgttgccggagacggagttgccaccgtaggaaccgcagcccagcgtgagcgacggggcgatggagttgtagatgtcgccaatgccgccgagcgagctcggctggttccagatgatgcggcaggcgtgcatgcgcaggccgtactcgcggacgaggtcgtcgttgttcgtgtggattgcggcggtatggccggcaccgtgcttgagcatctcctcgcacatttcgaagccctgctccttgtcggagaacttaagcacggcgtgcaccggcgccagcttctccatggtgagcggctcgttctcgcccacctcggagcattcggcagcgaggatcgtggcgtcctcggggatttcgaagccggcttcgtgcgcgatgtactgcggagacttgcccgggaccacggagttgagcttcggggtctcgccggagaacgcggtgcagccgaacatgtacttctcgagcttggccttctcctcgtcgttgacgaagtatgccttgcggcgcttcaattccttgacgagcggtgcgtagatgtccttgtgcgcgatgatcgcctgctcggtggcgcagatcatgccgtagtcgaagtgcttcgagaggatgaggtcgttcgccacgcgctgcacgtcgacgttgttgtcgacgtaggccggggcattgccggcgccgacgcccagggccggcttgccggacgagtacgcggccttgaccatgccggggccgccggtcgcgaggatcgtggccacgccgggatgctgcatgagcgcgccggtcgcctcgatggacgggtgttcgatccactgcacgcagttctccggggcacctgcctcgatggcggcgtcacgcacgatgcgcgccgcttcgacggagctcttctgcgctcccgggtggaagccgaagacaatcgggcaacgggtcttgagggcgatgagcgacttgaagatggcagtggacgtcgggttggtcaccggggtgacgcctgcgacgacgccgaccggttctgccacttcgtcgatgccgagcacgtcgtcttcgcggatgatgccgacggttttctgaccggccatgtaattggtcacgtgctcgcaggcgaagatgttcttcgtcgccttgtcttcgacgagtccacgaccggtctcgtcgactgccagtttcgccagcaccagatgcttgttgagggcggccacggaggccttcgccacgatgcgatcgacggcctgctgatcgagcttttcgaattccgccagcgccttctgcgccttcctgaccagagcgtcgacctcggcctgtgccgcggccttcttgtcttccacattcacagcaagcttggccgccttcgttgcggtctcggcgctgttcttgtctgccatgcgaacctcctgtagattcggcaaatcggtgcgccccgtggcgcagatttcacgagatgtgagttgtctcacaatctagcgaacaggcactgcggaaagcaagtctgcaatcacaatccgtgtgtctgttctcttttgtgcgtttgatgaactcattgtgtcactaattggcagatttccatctcaatttgagttacttgatacaaattgttcactttcatcgacaagcgcacacagtttcgcactcgacaatccactcacttctacaaatccttttccaaaagtccacgttttgttgaatcttttgaaaatcagctttgcaaaactggtggcatccgatatccttgacctacacgagccggtcatagagagagtcgccggcgaatagcagcgggcagggaagcacatggaaagcacgaccgtcaagcggcacaaccgcgagctcatactgcgcgagctgttcgcggcgccgtccatgaccaagcggcagatcgcagacgccacgcgcctgagcatgcccacaatcaccgagaatctgcgtgagctcgccgccgacgggctcatcgtcccagcggaggcgcgggcctcgacaggagggcgcaaagcccagacctggcagttcaatgcgaggcatcgcacggcgattggcgtcgcgttgcgacccaccgaggtggtgtgcatggcggtggatctgcgcggcaatgtgatagccgagcacaaggtgacgatggcacgtcgcaacgacaacgcgtactacgaacgagccgcgcatacgatctcgacgttcgcacagtcactgccctccccgatcggcgtgtgcttcgcattgccgtcgagcgcggcgcgccactgcatctgcgtggccgaggactggaatgcggccaccgagtcgtaccaaggcatcagtcgcattctcacattgccctgctcacgcattgcgcgcaacgtcgcctacgccaccgtcgaactgcataaccacccgttgctgcgcaacgcggtgtgcctgtacctgggcgagtacatcaacagcgccatcgtgatggacggcgtcgcacgcgaaggcaatctcgagcacatgcaactcgatgcgagcggtgacatctgccggtgtgggtcgcgcggttgccttgaggtgctgtgctcgtcgcggcagctcaccgaggagggcgagagtctgcccggtttcttcggcgtgctcgagcagggcgaacgcaatcatcatgtgcgcatggaccgctggctcggatcgctcgcccatgcggtcaacaacattcgcacattcgtgccggcggatgtcattctgtgcggaccgatcgccgactatctcgacgattccgagatcgcccagctcgagcgcctcaccacctgcgccgaacacgtcaatccgtcggcgcgcaacccgcaggtcatgcgcggctgctgcgtggagtaccaggacgcggtgggcgcggcgcagtcgctcatccccgcctcccacgacggcataccgtccgactgactagtgcggcggcccgcattcacctcattcgaagattcgcccattacactggaaagctatgcagttacagaaattacagcgatacgccacgcgaccaggcttcttctacaccgatgacggcggcgcggacgtcgtggtacgttctgagaccgcggaacaactgtggttgagcgtgctcgagccggtggacaaaccgagcgcgttctacaaccaggcggttcgcctgcccgatgacgcagcggacaggctcctcgactacatgcgccattacccgatctgctcgcgcatcgtgcctgcgctcggcctgcgcgagacattgttcaagatgaccggcccgaactatggcctgtggaacctccatctcgacaaggcatgggacggtctgcaatacggattccgcgccgacggaacatgggacccgcatcacggcctgcggttcaacccgtacaagttcctcatcgacccctatgccaagggcattgagcgggcgatgcaactcgacccttccatgttcgcgtaccaatgcaccataggcgacgacggcaaggtcgaaggagactcctggggtgaaatgagcacgctcgattctctgggccattgcccggtgtcggtggcgatcgacgaccgtgacgcccgcaagcacgacggcgacccggaacacccgcatgtgccgtggagcaaaacggtgatctacgagctgcatgtgaagggcttcacgaagaacgcgccatggttgccggaggagctacgcggtacctacgccggcctcgcccaccccaccacactcgcctatctgcaggatctgggcgtcacatcaatcgaactgttgccgatcatggccaagcagcccgaggtgttcctgcaggaacgcgtgcgcacgaactactggggctattccacgctcaacttcttctcccctgagcccggttatgccacgaagaaggctcaacaggccggtgccgccgccgtgcgtcgtgaggtgatcgacatggtacgcgccctgcatgaatccggcttcgaggtgatcatggacgtggtgtacaaccacacctgcgagggcggcaatgccgggccgagcgtctgctggcgtgggctcgacaatctctcgttctaccgccagcagacccagcatgccggcgagctcgaagacaccaccggctgcggcaacaccgtggacttcaccgacacccacaacatcacattcgccgtggattcgctgcggtactgggccaagcgcataggcatagacggcttccgattcgacctcgccgtctcgctggcgcggctcaagggcatgttcaccccataccatccgttcctgtacgcattgcgttccgaccagctgctcggcaacctcaagctcatcatggagccgtgggatctgggcttccaagggtggcgcaccggccagttcctctcgcccttcggagagtggaacgaccgattccgcgacgcctcccgccagttctggctctccgacatcaaccagactgcgggccatggtgtgaccaccatgcaggagatggccacgcgcctgtgcggttcggcggacctgttcgccaccgacccgggccgtggcgccacgtcatcgatcaattacatcagcgcgcacgacggctttacactggccgacctcaccagctacgaccacaagcacaacgaggcgaatggcgagaacaacaacgacggcacgaacgtgaaccattccgccaacttcggcgtggagggccccaccgacgacctcagcatcgagagcgcacgcgaacgttcgcgcatgaacatgctcggcacgctcattctctcgcttggcacgcccatgctgctcgcaggagacgaattcggcaacacgcaatacggcaacaacaacgcgtattgccaagacaacgagatcgcctggctcgactgggattggatcaactgcacagaggaaaccgccgaatcccgccaactcgaggccaccgcgaatctgatcgccgtgcgcaaatcgctcgacatatacaatcacgaggacttcttcacgaggctctcccagttggggctgctcaagccgagctcgcgtgtgcagtggagcctgccggatggcacgatgcccatggattccgattggcgcgacccgtcggtgcgctcgttcatgatgcacttgtatttcaaggacgaacccgacgcgctgattgtggtcaacggcgatgaaaccgaccgccggatgcacctgccgtcggattcgacgttcaatctgctatggtcgtcggcgcagaccactggcgaacagcccgcaccgggcacctccgtcaccaagatcttacggtctgcggcggtgtcgccacttgcggagacgctgcggttcaagcgtgcgacgtcgcccctgcacgatctcgacgcccatggtgccgttggcgcggacgccgaggagaatgccgcccgtcaggagattggaaccaccaagccaacggcaaagctcaccgcacatgagacgcagctcctcgaatccattctcgaccgcaagatcaaagacacactcgaccagcagatgccgccgatgaccgccggtgcacactccggaaccggcgaccccacacgcatcagcatggccgattccgatcccacgaccaccgcattcgacgtcgagcacgatgcccctacgcccgaagacaccgctccggctgcaggttcccccaatgccgtcccatcgaacgtgtggaccttcccggcgctgagcataagcctgctgctgcaatcggagcgccgctcctggtgagtggcgagccgagtccacgacctgaaccagcggccatggactcgacgccttccgaaaaacaagaaggccgccctgcattgcagggcggccttcttcgcgtataacgcttaacgcttcgagaactgcggagcgcggcgagccttgtgcagaccggccttcttacgctccacgacgcgggcgtcgcgggtgaggaagccagccttcttcagtgctgcgcggttggcatcgcggtcgatggcgttgagggcacgagccacgcccaggcggattgcgccggcctggcctgtggtgccgccaccgtcgacgagcacgattgcgtcgaacttaccttcgagcttcaggagcacgatcggcgagttcacttcacgctggagcagcttcgacgggaagtactcctcgagcgtacggccattgatcttccactcgccagtgcccggaaccaggcgaacacgggcgacggcttccttacgacggccggtgccatagcccggagcgatcgtggaggtgccggtgcctgcgcccgagttggtctcggtggtgaaggcggcggtggtttcctcggtctcggtaaccgcggagttgttggtattctcagccattgttcttatctccttcggttcactttgcctgctgcgagatctgctcgatctcgtagacctgagggttctggccaacgtgcggatgctcttcgccggcgaacacgcgcagacgggtcagctggacctttgcgagcttgttcttcggcagcatgcccttgacggcgtgcatgatgatgcgctcgggcttgttcttgagcagctctgcgtagctgtcgcggcgcaggccaccaggacgaccggagtgcgagtagagctccttgtccatcttgtcgccggtaagagcaatcttgtcggcgttgatgatgatcacgtagttgccggaatcggcatgcggagcgaaggaaggcttgttcttgccgcgcagcaggttggctgcggcgacggagagacggcccagaacgacgtctttggcgtcgatgatgtaccagtcgtgagtaagatcagctggcttcggtgtgaaagttttcacgatataccttttctgtattgtgttccggatcctcgcgctgcgggttggtcagaccgtgcggcgttccgatctcattaccgtgggctccctgaaagtccttatgcgagtgggaaagcgctttgaaggaccccgtagggaaacacaacaatcctttattatatccctcggcttgacatacgcgtacgcgcgatggcactctcccgcaccccgttcacagacggcaaagcgccggcgcaatatcgatacgccggcgctttcgcaataaggtgcggggccgcccatcagctgttcatgatcttggcgatgcgctgcagcagatcggagtcgaacaggtgctcgagcggcacgttgtcgccgtggtagtcggccaacggcacacgccagttcggatactcgttgtcggtgcccggctggttctgcgtgcggcgttctcccaccgcgtcgacgaaggagacggccttgagcttgcaaggcgagctgttgagcgcacggtagagcgcctcgacgatctcctcccacctgccggattcgtctttcatcacattgacatcgaggtagccgttgtcgacgagcatctgcagcatggcctgatgctcggcgcgcgcgctgcgctcgaaggccgacgaatcctcgccgagcagaccgagctgctcgcgcacgcgcacatgctcgtactcgagatagccggcagccggcggcatgtcgtggttgtccaccgaggccaacgcatacgggcgccaatccttcggcggaatgaacacgccatccatctgctcaaaccattcgacggcgcagccgaagatggcatagtcggcgagcgactgctgcacgtacgacggcacgacaccgaggtcctcacccacgatcagaccaccaacacggtctgcttcgattgcgagaatgcccagcatcgtgttgtggtcgtagtacacgtaggtgccattcgaggccggctggccctccgggatccaccacaggcggaacaggccgagaatgtggtcgatgcgcacagcaccggcgcagtcgaacatgccacgcaccatctcgcggtacgccttgtagccggtttccttgagcgacagcgggctcaacgggggttggctccagttctgcccctgctggttgaacatgtccggcggcgcacccacggtggcgccattggcgaatcgctccgggttccaccacacctcggagccgtcgggatgcacgcccacagccatgtcgctcatgatgccgatcttcatgccggcctgacgtgccgcctgctgggccgcatgcatctgctcgaccgcaatccactcgagccaacggtagaattcgagcaggtcgctgttctgctcgcgcagctgcttgacctcgggggaatccttcgtgtacttgttgatccaattgtctggcgtgttctccggcttgccccacttcgcatagcagacgcaccaggtggcgtatgcctcgaggtcctcgccgcacctggccttgtagtcgtcgaaggcctgctggcgcaccgactgcaggcccgtgttgaagatcgtgcgcagcgccttctctttctccagccacatggcatcgcggtctatcaggttcggatcggcgttgtaggcctccatcttggcgtgcgcgtccttgacggactgcttggcggcatcgtccaacgcgtagtactccggaatgtcctccgggtgaatgtaggtgtagttgatgaagcgacgcgacaccggtaggtatggcgacggggtcagcggtgagaccggttcgccggcatgcacagggttgatgagcatgaagtcggcgttcgtgtaccgcttcgagtcgatgagcaacgtgcgcagatcggcgaaatcgccgacgccccaggagtcggccgagcggatcgaatacaactgggccatccagccccacaacgacccgttcttgagcggatcgagcagtgggatgcgctgtggcgcgctgatcagcgtcgcatccgcctcgcgctgccctgccgcgatatgcagcgtgtggtagccctcgggcaggtcggcaggcagtgcgatctgcgccgtcgagaagaacttgccgttgacttcatgcaccttgacgtcgggcagcggctccaccgcgatgtcgtgttggtatatggtgccgtcttcgagtgtgatcgtgaccttcggcgcctcggtgatggccagatggatgggcacgtgactctgctcgcccacaatgtgcagcacggtgggttcgatgagccgcatggcgcgctggttgttcacatgttccaacgacacttcgatggtctcctcgctggaggcatcgacattcagggccttcagcacggccacgagcacgtcatcgggaatctcatggaaatcacgcgacatgccgacataactggtcgccacgcccagcgactgcgcgagacgaataagggggcgcgcaagacgctccgggctttcttcgttgagttctgccataactcctaagtgtaagcctttttcgcagcgacgttcccggctacgcccataaaggagcaaacgttttcattcctctcaccgagatagccgtgggttacgctcggaaggtcaccggcgctgtgccgccttcgccacttcgggcaccggatcttccttgagtcgctcgattgtctccgcaccggcattcggattgagcgccacgccgcgacgcaccatcgtcgacaggatccgcggagcgtccggctcaagttcaacgccgagtctgctcagaaaatcgagggtctgcgcgtccacctcaggattctgcgccccctccatgcgcattttccatgacgtctgcggattacgcagtgcctcgtcgcgcacttcgggcacctcgtctttggtcaggcgccccaccagccagttcttgtcgtcgcggttcgcggcgaccgcacgccgaacctcgggggaagggtcttcagacagcttgacgagcacattcgggaacggcatcgtctccgcgaggaacacgcggtcttccaacggcgtgtgctgattgccggcgaccgcctcgagcaatgccgtcgcacgtgagaacgccgcctgtttcgcgcgatccggcaacggcctgcgtgcgaattcgtgcagctcctgcggatccgtcgaatggcgcagacgttcataggtcacggtgagcggttcgaactgcggagtctgggcttcggaagcctccccctgattcccggccgcgtcctgcacgccgtccgcctgcgtattccgcgcagtctgtgccgtctgctcgccatctgccatgctgacctccacctcatgcgcatcgtctgcgctccgtgccgtgcaccccaagtctaatgcacatgcggcaatgggcgcggcaccggcatcacgaggcggcgtgcggcgtgtcaccgcatcgcgcggtggcatcggcccacatactccggcgtcaccgtcgcactgaactgctcgcgcacacgatgttcgaacgattcgcgcgcatcatcgcgcacgagcacgatgagcaccacgtgatccgagaaatcggcagactcctccaccgcgcccatcacctcgaccagatggcgcatcggcccgagctgcgagtagtcgagcggcaccgcataccgggcacagaccacaatctgtgcgacatccgctgccttcaccgcaatcgacgctccggtggagtatgcgcggatgagaccgcccgaaccgagcagaatgccgccgaaatatcgcgtgacggcaatcacgcaatctgtgagttcattcgcacgcaacacatcgaggatcggcttgcccgccgtgccgctcggctcgccatcatcgctcatgcgctccatcacacggccatcgtcaccggtcacaatcgccgcataggccacatgtcgtgctttcgggtgacgctcgcgcacggtctcgacgaacgcgagcgcatcctcaagcgaatcgacatggcaggcgtcgcctatgaactcggacttcttctccacgaatgcatcgtgcgccggctcgtcggccggattcaacaaggtacgcatggctcctcgcaaacggtctcgtcacttctgggtatgcagaaccacactaccgcccgctagacgaccacgttgaaatcgccgccctcgtagaacgagacgatcgcctccatcacctgtcgggtcaggctggcataggcgccatcggcccgccaggcgacatgcggggtgagcacgacgccgggaaccgaacggagtggggaatcctgcggcaacggctccttgtcgaacacgtcgagaccggccagcaggtcgccgcgttccaagcgccgttcgagcgcgcccggcgcgatgatctcggcgcgcgcggtgttgatgagcatgcttccgggtcgcagatggttcaggttctcgaaggtgatgccgccacgcgtctcatcggtgagcggcaaatgcagcgacacgatgtcactggtggccatgaggtcgtcgatgccatcgacgagcgcgatctcgggattcgcagcgagcgcgtcggcgtgcacatgcgagttccaaacctggattcgcatgccaaaaccgttggcgatgcgcgccacatgctgcccgatgccaccgaatcccacaagaccaagcgttttgccggcgagctcggtgccgaacacaccatgccaactgccctcgcgcacctgcgtgtcgagctctcctacatggcgcgccaactccatcatgagcgcgatggcgagctcggcgaccgcggcgtccccatatcgacgcacattgcatacgcgcacgccatcctgccgcgcacgggcgaggtcgatgtagctggccaccccggtaccgccgaatgcgaagcacttcgcatgtccctgcgtatgcgtgagccgtgtatacagattgtcgtcgatgtgcacgccgatcacaatcacggcgtcggcaccctcgcaacgccgcacgatctcgtccgggtccagagtggtgtcagtgtacattctcaggcgcgtcacatcgcgtagcacctcgaagttcgccttgaacggctcgatcatgtcggccaccacacatggcatcactgtgaggggcagatcggtgcgttccggttgggtctcaagaatctgtgtcatggccgacactgtagcggcaccatatttccgcgagtttccgaatcgaatgccacagcagaccacctcggacccgtctcatatcgagaccggcgatttgcctcacgcatgccgttgcactacactcggcaagcgaagcaacggacaatgacgtaccgctgcttcaactaacttcacaatccccttgctggccattgtgcacatcatatcgcggatttgacgacagggaatggcatacgacaatcaatgtcgttcgactcgcccgaaatggccgacacaggacgtgcaaccctactggaacccatggaacagacagaagccgtccgaaacggaaaaaggcggatcccaacggattcgccctgatcgcggagtcagagggattcgaaccctcgagccgctaaacacgactaacaccttagcagggtgcccctatcggccactcaggcatgactccatgctgcattagcgcaacaaaagaacatcatagcagattcgacagacgaaacaccgatattcgccaattcagcgaaaacgaccttgttgtggagcccctccctgttccgcgacgggcgcgaatacaccggcgcttccattcgaacatctgttcaggtacagttgagacatgagcacagcaccgcgtatcgaagctgccaaaagggattggggccatgacgagaccggctgcaccatactgcatatcgacatggacgcgttcttcgcctcgctcgagatagcaagacacccggaattccgcggcaaaccggttattgtaggaaccggcaaccgcgccgtggtctccgctgcaagctacgaggcccgcaagtacggcatcaattcggcaatgccggccgcacgcgcgcaccaactctgcccgaacggaatcttcctgcccgtcgaccaccactactacagcgccgtctcccatgagatcttccacacggtcttccgcgaggtgacggaccgcatcgaacaggtctccgtcgatgaatgctatatggatgtctccggtgcgctgctcgcatggcacagcccgacgcgcatagcccaatggttacgggcgcaggtcgcggaacggttcggcatcacctgctcggtgggcatagccggcaacaaactcgtggcgaagatggcgagcacgaatgcgaagccgaacggcatgctgctcattccgctggacaagcatgcgcagttcgtgcagctgatgccattgcgaggcattccggggcttggccccgcccaggagaagcggctgaacgcatggggaatcaactccgtgtcccagctcgcacgctgttcggtggaggagctcatacaggcgaccggatcgaaagccgccgcaacacacctgtgggaggcctcgcatggcatcgacccgtgcacactcacgctacacgcccccgagaaatcaatcgggcaggaacgcaccttcgatacggactgcaatgatttggccacagcgagcacgctgatcaaacaatgctgcgacaaggttgcctccatactgcgcgccaaggggctcatggcgcgcacgctcaccgtgaaactgcggttccccgaccttgcctactccaccaagcagatgcaactggaacaaccgaccgacgccgcgagcacgttgtacccgcatgccatcgacctgttgttgcgcatgatgggcatgccggcggattgccgcggcactgaggtcaaactcacacgccccatacggctcgccggcatcagcacgagcacattgacaaagcgtgaggagacggtgatccaacccacgctcgatgaactgctcgaggagaacgagcgtgtggcccccatgccacaggcatcgtcatcgattccctcccccgcaaacggcacgaggtcgacacgcctgcgctgcgctgaagaggcagtagaccagatccggcgtaaattcgggcaggatagcgcacatctcggcgcatagcatgcgcccaatacgagcaattgaataagaggcggcgtcaggcctgtgcgagccgctcacacgcccggtgaatctgctcgtcggtggcggtggccgagaaccgcagatattccggagcaccatagaattcgccggggctggcgatgataccgatggaggcgagcgctttcatatcggtccagcaatcagccgacttcgccttcgtccatacgtacaaggctccctggggcatgttcacccgatatccgtagccacgcaatgcgcagacgagctcaccgagacggtcatgataccggttgtgctgtgcacgcaccgatgccgcgtctcgtaagccggccgccatcgccgcctgcaccggtccaggcatgatgaggccgagctgtttgcggaacgcggtcatacgcgagatgatctgtgcatcgcctgcgagcagtgccgtacggtacccggccatattcgattgcttgctcagcgaatacaacacgaccacaccatctgcacgtccgtcgcacacgtcggcgcgcaatgcgcagggggacgactcgatggcggcctcgcggttcccctcgtcgtcattggccttggtccagttcatcaacgcatagcattcgtcgctgagcaccacggcgcctatctcacgggcggcgttcacgatgtcatgcagctgcgcggcggagagcaccgcgcctgtcgggttgctcggcgagttcacccagatcgccttcacaccgggtatgttgcgccatgaatccactgcggcgacgtcgtcgaccttgaccaccgtggcaccagccacctgggtgccgatctcgtaggtggggtagctcacgcgcggttggactaccacatcgccggagctgagttggagcagcgacgccatcatcgccacaccctccttggagccgaccgtcggcaccacatcagcccctatcgcctcgatctccacatcacgacagccgcggaaccattcgcagatcgcacggcgcaggtctgccgtgccgccagtcaccgggtagccacaggcgtttgcgtcgttcgcgctgacggcgagcgccttgcgcacggaatccggtaccgcatccaccggcgaaccgaccgacagatcgaccatgccaccgggcaccgcctgcgcgatgcgtttgtaccggccgacgcgagaccaatcatatggtgtgctgaaatccttgaatcccatggctctcctacgaatacgggcgaatgcgagtgacttgtatcactatggcatcgcgtgcgcctgggaaggcgcacgcgattgcagattactatgctcaggcggcgttctgtggcggcagatcggcgacacgttgcggatccttgccaatgggaccggcagcctgtgcgccaccgagatcgcccacctcggcgaagaactcaacggcggcatccttgtaccactcccactccggcggcagatcgtcttcatagaagattgcctcggtcgggcacactggttcgcatgcgccgcagtcgacgcattcgttcggattgatgtacagcgagcgcttgccctcgtagatgcaatccaccgggcattcgtctacacacgccttgtctttcacgtcgacgcagggctgcgcgatcacgtaggccatggctcctccttgtttctcaaagtccctaccagactacccgcctacacccataaaacaaagcgcgggcatgtccttggcgaacatgtccgcgcgtgcgcaaagcggcaataggggccattcaccgtccattcagcactggcgtgtgaaatggcgggcaaatcgatttcagtctttgccggcttcgaccttggtcacggccgcgtcattcccccggccgacggaaccggactgtttcgcgcgctgcgccttgagctggcgctgcttctcgtatttgaccacctcggcgtcaagttcaccggtgcccacgcgcgcatggttgtacccgtaggcaaagtagatgatgaagccaaccacgagccatatgaggaagcgaatccaagtgagcacggtgaggttcagcatgaggtagaagttcgcaagcgcgacgagcagcggaacccacggattgcccggcattctgaagctgcgtttcagatcgggcctgcgcttgcgcatgatcgggatggcgagggccaccagcgtgaacgcggaaagcgtgccgatattcaccatgtcgctcagcacgtcaatgttgaagcacgcggcgatgatggcgacgaccacgccgacgacaatctgcagacgtgccggagtgccgtgcttgccggtggtcgaaagggtacgcggaagcaaaccgtcacggctcatggcgaacacgacgcgcgtgagtcccaacagcagcaccatgaccacggtggccaagccaaggcagatgccgaagctgatgatcttggcggcccagtccgcccccaccaactcgaatgcagtggccagcgacgggctctcgacggaggcgagctgcttgtaggagaccatgccggtggtcacgatggcgacgagcacgtacatgacgatgatgagcgacatgcccacgccgatgccgagcggcacgttacgcttcggattacgggtctcctcggatgcagtggcgacgacgtcaaagccgatgaaggcgaagaacacgagtgcagcacccgagatgatgcctggaacaccgtagatggtcgggctcatatgcgtaagccactggaacagcggttggcccagggtcccgtgcaccgtggtcgcattcgccacgtccgccgagggttctgccggcgggatgaacggcgtgtagttggaggccttcacatagaagaagccgacgatgacgacgaacagcacgacggctatcttgagcacggtcatcgcgccgtccacgcgtgcgccgatcttcgtgccgagcaccagcagcgtggtgaagaacgcgacgatcacgatgggcgcgatgtcgagatggaacgagccgatcatgatgttcgtgttgaagttgacgcccatgagacgcagaaaatcgttgagatacacgccccagaacttggagatgaccgaaccggccatgagcatctcgagaatcaggtcccagccgatgatccacgcgaaaatctcaccaagcgtggcatacgtgaacgtgtacgccgaacccgccaccggcatcaccgacgcgaactccgcatagcacatgaccgccgccccgcacacgatgccggcgatgatgaaactgatgataaccgccggccccgcgtggaatgccgcagcctgcgcacccaccgagaagatgcccgcgcccacggcgacggccacgcccatgacggccagatcccaccagccaagattcctcttgagagaatgtccctcttcctctgtctccgccagcgtctgctcgacggacttcgttctaaaaatctgcacgatgtgcccttatactcccatgaacaaactcaccggtccagtgtgcttttggctctctgtcggttctattgacgtcatagtacgaccccttgtttacggattacgctctgagtaatccgcacagcgtaacaaatccggccacatatacgggaaacgcccatatattgctccccaaggaacaatatatgggcgtttcttcgaatatcgccgtatgaacacagaacacgggtgtgcaccatctggaatacggtccagattgtccggcaccgtcacaatgtcacgttcacgagcacgggctcgggaatcagcgtcacaccgaactgcttgcgcaccccatcgcgaatcgcatcggccaacttgacgatgtcattgcaggtagcgccaccgcggttcgtgatgctcagcgtatggagtgtagacaggcccgcccgtgcatcgtcagacagcttgtaccccttgtggaagccggcatggtcgatgagccaggcggcggaggtcttcactccggtcgagccatccggcaacgtggccgggaagcgcggcgcatcctctggcagacgggcagcgtcagcttcgctgataatggggttcatgaagaaggagccgcaagaacggcggttcggatcggaattcgtgccggtgtcggaagcgatgtcgatgatcatgtcccgagcggcaccatcatgctgctcacggaaagcatgctgggcggcgatggcagcctccacctggtctgcgcgcttcgtgcccatcatgataggctcacggtaccgcgtggcgtcctcaagcatgcctttggaggcgcgcacctcgagcacggcggcacggatgcggtcgatgggcatgcggtcatgtagattcacattcaacgcgctcgccagctgcgggtagttcacggtgccggttccggtgtgcacgagtgcgaaggtcacggacagcacaatatagcgcggcgtcgggtaatactgcgcgttcgggacgccaggagccttgtacatgctgcgtttgagcaagctgaaccggtagccgaactgcatgtcgacattgctcatatcgagcgtcttcttctcctcgcggtcccacacctcaacggattccaccgcggaggcgacctcctggccatatgcgccgatgttctgcaccacgctcgcgccaaccgtgcccggaatgccggaaagcccctcaagaccttcaagtccccgttccacgcagaactgtacgaggtcgtcccagttcacgccggcctccgcgttcacatgcacggtgtagtcgccgccttcaacgggggccgcttcatctggcacgatgatgttgcggcgtgcgtcacggatcaccacaccgtggaattcgtcgtcagaggcgagcatgttcgaaccgccgccgatcacgcagagcggaatgcctttggagtcggcgtcctccacctcctcgatcagcgccacgcgtgtggtcggttcgacgaaacgttcgatatagccaccaacatccatggtggtgagttcagcaaaacttgtcatacagcccacagtaacaaaaaacccgaccatctggccgggttttaagattagcttagaagccttggatcagcgggtctcgcggtggagggtctgcttgccgcacttcgggcagaacttcttgagttcgagacgatccggggtgttacggcggttcttggtcgtaatgtagttacgctccttgcacacggtgcacgccagcgtgatgcccggacgaatgtctgcgctcttgcttgccattgaattcacctcatcttgtcgttaagctgccggttacccgacgtagtagcgagaaagagactcgaactcttgaccttacgattatgagtcgtacgctctagccagctgagctatcccgccatcgagcctcgagtgagaatcggactcacgacctcttccttaccaaggaagtgctctaccactgagctatcgaggcgtggcggatagtggattcgaaccactgaagcacgaagcgcctgatttacagtcaggtccctttgaccgcttgggaaatccgccatcgttttcggttgaggtctcaaccggcaacttggctagtatggcacataagccgtacatcagcaaccctcggcgtgtcgcattcacatgctcgccacaatccgggcttcgagctcccgcgccatatccagtccgattccgcctgcgcctattcaaagcactcacgccagatatcgaggcacccaacgatgcggatgcgggcgcaccgcccgtacgttacatcgccccacggtcatatcgtgcacgcaggcacgaaacagccagtgtgcggcatccttcattgtccacattgcgcacagtgacacggaaaggccaacagagacgccagacaaacgaaaagccggcccgcaacggaccggcttcgaaaggcaggactagctcgaactagttcagtcgttgaccaccgcgagcaaatcgcgagcggagacgatgaggtattcctcgcccttgaagtggacttcggtgccgccgtacttcgagtacagcaccttgtcaccgaccttgacgtccatgggaacacgcttgccctcgtcgtcgcgacgacctgggccaacggcgaggacttcaccctgctgcggcttctccttggcgttgtccggaatgatcagccccgatgcggtctgggtctcggcctccgcctgcttgacgatgattttgtcttccaacggtgtgagtgggaacgacactgcgcgcctctctttctagagttcagtatttccgcgccagaacatgcggcggcggctgacgaacaccgttgcacactcctttgcgctactcacacatagtagcgcgttcgttagcactctgccaactcgagtgctaacgctttgagagaacagctgacgccaatgtcccaggaacacgaaagccgaccttccggccggctttgcaattcaggtttggcgtttcagttgccgcgtctggcaagaatggattgcaaatccacaccgagcgaatcggaggacgcatccggggcctccacattcgcctgcgcctcgctgttgtggaaggcgaccgagtcgttcaccgagacggcggagacggtctgcgcctcctttacgtcggcgttgtcggctgcggcatcccgagattccgcagcgccggcatccgccggcttggccgatgagctgtccttcggcacggccttggagacctgacgggtcgacttgatttccatgctctgaacgacttccggcccgtcgaacggatcggaaccaagcgagaacgagatgaggtcctgattcaccgccatgtcgaaggcatccggtgccgacgacgcattgatctgcgcgagctcgttcgtctcatcgctcatctgcgctgcacgctcctcgcgaatcgtcagatgccctggattatgagtggcctcttcggcggcctgcaccgcggcatcgacgtcggcatgttccgcacgcatgccggagcgcagtgacgcctcatccgcatgatggtcacgagtatcctgcgccttgcgtcgcgcaatcgcccgtgcctgctcctcgcgggcgcgctgcaaggcctggtgaatctcacgtgcctccatgacgtcggtctgcgaaccgtcttgcatctgcctgcgggccgaaggctcaggatgtgccgcacgcgtgcgctcctccacgacacgcttgttctcacgcaccttgcgttccttgagttcacgctgccgctgcgcgtgtctgtcctcccattcgcgggcctgtcgggaggcatgcgcccccagtgcgagcaccacgcacatgagtgcaataggtatgagagtgaagtatgggctgaagacgagaatcaccgcgagcacaaacacgagcaccgagatgcccagcaacgccccgacgagaatcttgcgtcggcgtgctgcagcgcgacgtagatcgcgcacctgtgccacatattcgcggtcccgcacagtgtgtggcgaagccatgggcgtccctttcagctcgacagtccgcgcatccgagaatctggtgccatcgccctcatctatgagatgaagcgaggccgagtaccggtcggactggtgtttgatcacctgcttcatgccttgaaccgtccgtctgggcagccaagacaccatgaggatggcgacgatcaccaccagaacaatggtgctgagcgactcgtaatccatagttcctaagaatagaagaacttatgacaagttgtgtagcgattctccgggcgtgtcgcctaaaagacgatgcacgaacccctgtggcacatcggtgtccagcagactgtacgactcgtggtcgcgccactccccatgcacatacatatattgacggcgcacgccttcgtacttcgccccgaccttctgcaccacgcggcgggaacgctcattttccggcactatatctatttccagacggtgcagctgcggtcccgtcgggtccagcaacgcccagtcggcgagcatggccacggcgagcggcgtaagtccccgcccggcatgatcctcgtcgatccagtagccgatgattccggtgcgcataggtccggggtaaatcgcaccgagcgaaatctgcccaacaatttcaccttcatgttccatcaggaagatgatcgacgtgccttcacgctcctcctcacgctgcctgttgacccacgatttgaaggtgagcggctcggtgccgtgcgggtccgacgattcccatggcgccagccaccgctcgttcacactgcgcaggcgaccccactcctcctgatccgccgcgtccatcgtcctcagcgtgaggtcgggcgaaccggcaggggatttgagcgtcaatggcgccgtgaaggcgctgttcctgcggcgtttcatcacatcatgcaaggcttggaataccgacataccaacattgtgccacgccgtcagcttcttacgccgacatgcgataccgttctgtctatatattttgagacggcagccatccgcatagtagttttccgctactataagtcacaggaagtcagggtttcacagggggttgccgtggaaatcgacgcaatgccgcatgggggtgcgcaattcacgaacgtggccgaggcgaaacgcatgctgcgccatgaggtgttcgtgcgaaggcgtggcacgtcgctcagcatgagcatgcaggcgggcgagcaatgtgcgcagatcgcctgcgaggccggcctattccaatcaccttcgcgcatcattgcctgccatgtctccatgggcactgaaatcagcacgattccactgctgtcaatcgcgctcggttgtggctacacggtgctggtgccgaaaatgggcgtcgatctcgatctgggctggggtgtgctgcgctccctcgacgatctgctgcgcctgcatgtgcctgatgaggtcgccgtcgatcagatggagccgtcgctgtttccgcatgcgcaaacgcgtcgcccgggcgaaccggaaggccagacgtacccgccggaggcgctccagatgtgttccacggtgattgttcccgcgttgctcgtcaatccggccggcgtgcgtttggggcgcggcgccgcctggtatgaccgtgcgctccggttcgcgggtccgcaggctgatctgatggccatgtgctggccatgggagttcgtggacgccccattgccttgcgaggagcacgatgtgcgcatgaatgccgtgctcacgccccgtggattcacacgattgggctcgactggcccaacccgcgctcacaccgacgacccttcgtgcgactcccctgccggtgaacctgacgaataagatggcccgcactgctgttgtcggaggggaattcccgttgcgcgcgccgggtgcatgcggccattgtgtcggctcccgtattaggatatgtctgagcgagaccggtattcgtttggggtaaggagtctggaatgcctatctatcactaccgctgcaagaagtgcgggtatgacttcacgaaggagcagtcgttcagcgacgatccgatcaaggtatgcccgcagtgcggcgccgagcaggtgcataaagtgtatgccgctgtgccgatcacgttcaaaggcagcgggttctaccggaccgacagccatagctcgtcgaagtgacgcgatgccctttacaggtcgacccattgtagattagtaacgctgtatattaagtaacgccgttaattaaccacaatcacccgtcacgctggattcgcgcatcccaccaagccatcatggaaccatgatggcttttcttatacgattcgctcgcagattcctgccttcgtccgaaaccgaagacagaaggcatggcgtgtcgttacagactcgcagactgctgtggcagcttcgccacatgctgctggcgctgtctgtaggcgtggcgttgttctgcacactgcaatgcgtggcactggcgacggccacacggcaggccgtggtcgccgcgcgcgatctcgatgccggtctggtgattgcaaccggcgatgtggagatggtggagatgcccgaccatgacgccctgcgccatgcactggggtgcccggacgacgcagtggggctggtcacgcagacccgcatcgagaagggcgatattctactgaccaccgatgtcggtgagcttccccaagttcccgagcaccataccgtgatcgatgtgcgacttggactcgggcagcattccttccctattggcaccgtggtggaactgcgttcgacacaggcatgcgccgacgatgcccgcgcctcgccagaagggtgcgtagtgagcagtcacgcggtggtaatggcacaaccgagactcgacgacaccggctcgacagtgacgcagatggcgatgagcgccgtggaggcgttgcaggtgcttgccgcacaggagcatggcacattgattgcggcacgaggtgcgtcatgagggccatacgcccagccgctattggcgttcctcgaatacagcccaatgcgggggcagttcgccgagaatgcgcttatcgtcatcagcttggcgttgctgtgccgtctgcatctcggaaggttccggcttcacaccgtcggcgtcgaaccgctcggtgccctgatgcacgacgcgccggtgcacgcggggtgtacggcgcgtggcgctatacggacgcgcggcatcgtgggatgaggtcggttcctcgttcttgttggtcatagcctgcctactcggtagttgtcgccgatcgaagtcactgcttgtcctggtaaatctcgccgagacgtgcgaccacacggtccacttccttctcggggttcacaaaggcgccgacgctccatatggtcatgacggaccagccgaggctttcgatctcctgcggcagaatgcggtgacgctcccgagtggactgcatgcccatgaactgggcgtcgtcggtgaatacagccagcgcgaacggcttgtctttgagaccaacgaccatgggcagcttcatgccgccatcatagccatagtcgacagccacattgagaccgcgttcccgaatgcgggtcgcgagatcgttgaacagcacgttctcgtcggtttgcttaatcgccggacgcaccacattggcctcgtcgaggtcctcggcccactgcagcagcaccttgagcatcttggggccgtcctgatgcagacgatcgtcgtcgaggtcactggctccgaaggcactgacaatgtcgagatggtgatcgcacaatgcgagtgcatcgagcagcatgccacggccgccgttgttctcgagcacgccaaactgctggagcaggcgaccatgagtggtcttggcatagctcatcgacaggatcacgtcggtggcgcgggcgccggccacatcggcgatgtcgacgatgcgcacatggcgcaggaatcgacccatcgcctcgctcttcgccgccagggagcgcagttcggctcccaagcgggtgcggaacgtggaggtgaggcacacgacggtgagcaaatagctcggaggcacgagggtgaaggtctgcgcgcgctgggtgatgaggcgcaccacttcggcaatctcctgctggctgctttccacgagtccgctggccatgagcggtacgcccgcggcctcgatcttgtggaagcgtatatggccctgcatcggttcacgcacgacatcggtgttcaccttgccgtagccctgttcctcgaggaaacgattcacgcgcggatcacggcgagtggggtgagaggctaccgagatgttcggcagcattgacatgagcatgccgatgccctcactggtcaccgtgctgcgatgcgcgaggatgaccacctgacgtgcacggcacagaatgctgagcagcagcaccgacggcaggtgtgccgcggcatcgatgatcacgacgtcggcaatgggcgtcggatttgtcacggcagcgagcgtggccggcgtggccatgatcaccggtttggcggcagcgagaatctccggatggtcctgatggatgcggctcaacgaaatgctcgacgcaccagcgagggccgtgtgcatcatgttggcctcctgcgtgcgggagaacagcaggtcgcacagcctgcgcatcgattcctgcatgatcatggggccaatggagcgcacatgctccacatccacctgcacgaagcggtcggaggccgcctgcaatgccgagccgtcctggttcgaaatgatggccgaggaatgcacgatgtcgtcgaacacggtggtccaccatgccagtctgagctcgttgctcacggcgtccaccttgaccttgcgttcacgtaggtcgtccaccagctcaccgagaccggcgcgcttgagctcgcgttcgatcacgcaacgttccggcagggtgtcgagagccttgcggtcgtcgaatagggccttgagacgttcctccagtgcgttgaagtcctgctgctggagctccgccccggccggcgtggtggccagcacggtgtcaagggccgttagattgctcatgagctgttcctgggtggcgatgatgtcgtcgagcttcggcggcagcaccggccagccgccatgcggcacgaacagacgccactgctcgccctgacgcttcaccaccagcaatgcctcgtgcaggtcctccacctgggcgcccacgcgcagcatgctcttggcttccttgatgtgcctgcgacgatcccagaagcccatctgcgaatcgctcgtcttgcgctcctgcttcgactccgtagcctcgatcatcgcatcgatgtcacgctcgaatatctcaggctggaacacgtcgagcacacggcgcaggttcttgagcacggtgacctgcttgctccactcatcggcggtttgcggaatcgagaagccgcacaccttcacggtggtggtgacctgttcacgcgtggccggcagcagggatcgcagcacgttcaccacgcgttggtaggcgtcgatggcctcctcctcgctgtagagcgacgcaccgtaccatgcggtgtcatcgggccccaccgagtattcgccgagttcgccggcacgttcgagcttcttggcccactcatccagcgatttgcctatggcgagcgcgcattccttcgtgaggcgtacgcgggtcatcgggtgcgccggcaattcggagatgctggcgaggttctgaatcgtctggtatgcggagacgccccacgtctgattcacgccgtgcaggtctcccagatagcgggtgaggcgggatcggacgcccacgagttcatcggcgagctgttcgaaacgcgaggtggcgacgccctgctggtatcccaccgcgctgatgagctggtggtcgatggccgcattggcgttcgggttggccacgtcgagcaattgctcgcccaattcgttggccttcatgagcatggcgaatgtgcgcttctgcgaggtgacgcatggcacgtagagcacggaccggccggccatgatgcaacgggaggcgatcgacgcggcctgctcggcggtgtcgttgcccaatgtgccgtcgacgaacagcgaatggccggcggccgccacgttggcggcataacgcacggtgttgtcgacatcgcccacctcgtattcggagtgggggtcgccgtcgaaggggctatacggtggaagggtgatccgcgaaagttgctcgatggcttccgggtagccggccagggcattgagcatgacattgttgatcggaccacgtgccagccgctcgatgatcatgcggctttccatgaggatctgtgtggatgggtcgacgaagcagccgagaatgatctgccgttcgattgagaagtcggcgaacacctgttgcgccgccttcgtgatgaccgcgaatactgcagccgtctccggcgtgccgctggcatagttcgagccatcgaacagcgcgcgctcgtcgagattcacaccgttctcgcgcatggcattgaggaaggccgagttcaggcgcacatgaccggtgaaggtgatcgtcgtatggttctccacgggagtgccgtcacgcaccacctcgactgggtagagcagcaccggcatcttgttgcccttccacgtggccacgcccaccaccagggagagctcggcaacgccgctgatgcgcttcttggcgctttggtcgtcgagcacacgctcggtacgccgtgccgccgcgcgcagcatgccgctgtcgcggaacagcgaatgcaacggggcacttccgctggcgaacagctgtgagatgcccgaggggtgcgcatgggtcaggtcgagcttggcgctcagctggttcacatcctccaacggcgaggccatgaggctcgccctgtattcgtcacgccagcggcgcaacttgtctatggaaccgctcgtaggggccttcgtttctggtgtatcggtgttcgacatcgagctcacttccccattgccttgcgatagtcttcgtatcctgcgttcttgctgagcgcctcgtcaatatccgcattgccctgtgcggcgagccatgtgtacagatcgtcgtacagcgacgggttcatggccaggaacggcagcagttccgggtgccgtgccatttcgaactgctccgagaagtcgtcgctgcgccgcgcgtcgtccgaggtgaaccctgccaccgagaccagcggctccgacttggcgaaatcgccgttcgccaccttctcgaacaccgatccgggttcgaacgccggctcgtattccccctctgcagactcgtccgtctgcggctcgtcatgccgttggaaccgggagtagtccacgtccgcggcatccaccgtcaccgtcgccacctcgggtgcgttgtcgccgcgcaattcctgttcgtcctgcgacacatcctgcgcggcgagtgacgcgatgtcgccgttcacttccgtttccgacgcagcttcgtcggaggtggtgcccgcagatccggagggttcctcattctggcgcgattcctcgtcgcttacgggcgcctgctcgctggctgccgcggattcctccgcattcccgtccggctcctcaacagcgggtgcattcgcagatggctgcacgctctcgccgtgctcgccaatgccctgcgcagcgggctctgcggcgaccggctcggcaggttcttcctgtgtcgtctcctccgtgacggaggtctgctccaccacgatcgactcggatgcggcgtctacttccgcagcaggctccggcatgttctcctgaggctgtggcatgcttcgcggatgcgccgaggcgagttcgctcacgctgatcagacggtcggcaggcgcgccggcatgcttcggcttgtcggacatcttcggaatgtatgggtgctcctgggccgccgccggttccgagatcttgccttcggccacgtccttggcatcggcgaacagatcgcgcggcgcggcatcaccggcatcactgtcgtcgagatcctgcatcggcaacgggttgatcggctgcgtgaacggcacgaacgactgctgttcggcgtcatgcatgcgcttggcacgcgcgcgcaccatgctcgcattgaaaatgtcggtgggctctccggcacgcagattgagaatgtcgtccaccgacatgtctgccgcctcgggctcgttcgacgaaccctccactgcatagtcgaacagattgaccaccggtgcgtcgtctttcgtggaatcgtcgtcttcaatgaacttggtgaaatccacgggcacgtcgccgaactgcacgtgtacggaatccgactgcagcggataatcgactccactctgcagccgcacgagctcgtcgccagcacgcaccacgaaggttccgttcgtggagttcaggtcacgcagaaaggcacggccatcgagcgccaccataagctgggcatgccttttcgacacggagcgggagtcgtcgagaatctcgacgcgtctcttgccgtcgtccggcaagggtcgcaatggcttgcggccgatctccacggttgtgccgggctccacactcgccaattgtgtgccgtctacaagaatcacccacctggttgtagcaccctgctcgctgctcaccgttggccaccctttcctgcgttcgccgtcgtattggcatctgcgattcgcgctcgcctcttgtctgtagcaattctaccaatcaagtgaacaaaaccgtgcgaccggagcgattgagcgagcttttctcgctacagggtaagaaaagaggcccccgcatatcgatgcgggagcctcttgcagcctgagctgcgaacgcggtgtcatgcggccaagccgcacggatcacttgagttcgacggtggcgccagcctcttcgagctgagccttggccttctcggcgtcttccttcttggcgttctcgagaaccggcttcggagcgccgtcgacgagggccttggcctcggccagaccgaggttggtgatggcgcgaacagccttgatgacctggatcttcttgtcaccaacggcggagaggacgacggtgaactcatccttctcttcctcggccggggcagcgcccggagcggcggcggcgacagcggcgaccggagcggcggcttcgacgtcgaacttctcttcgaaggccttgacgaagtcggacagctcaacgagggtcatctcgccgaaagcttcgaggagttcatcctgggtgaacttagccattatggcttcctttcaatcatggcgttgaccggattattgggttgtggccaacacctcaaattttgttgttttccggaaaatacaagactcacgccgcgaggcgatgggtctcaggcagccttctcctgcttgtcgcgcagggcgtcgatcgtgcgaacgaccttcgtgggcagcgcgttgaacaggtaggcggccttggacatggtgcccttgagcgcgccggcgagttcggcaagcagttccggacgagacttgaggtctgcgagctgcttggcgccttctgcgtcgtacacggttccgtctgcgaaaccgcccttgacgatcagagccttgttggtcttggcgaagtcacgcagcaccttcgcggcctcaatgaagtctccatcgacgaagacaacggcggaaggacccttgagcatctcgtcgagaccctcaatgccagcttccttggcagcgatgcggaacagcgtgttctttgccacggtataggaagtatcgcggcctagcttttcgcgcagatcggagatctgcggaacggtaagcccgcggtactcggtcaggtagactgcgctggcgttacggaactgttccgtaagctcggcaaccaccgcttccttttcgggcctcttcatggcgttccttcctaagtcggccgttgacttcggaacaagcgcgggcaaaaaaattgccctgcacacaggcagagcatcatccagccgcaatcggcttcccggtgacgggagtatgtttctcaacctgcgttggcttgaaccaaattattgaaccgctcgcacggctcaaccaacggtctgtggtttacgggaattaaggtacacagtcatctcgacaaatgaaccatatgggcggatttcgtgaacatcggcgtgtcgcaacactgctattgagaacgattctcactttctgctaatctgcaaacagatacagcggcattgcatatgccgttagactcgaagaaaccccggaatggagaatgaatatatgaagagactgttgcgcacactcacgattctgctcgccgcattggccacaatattcgcggtggccggctgctcgaactcaaaggccggagatacccagattgacaaggagaaggtgatcacggtgatcgcctcgacgaacgtgtggggatccgtggccaagcaactcggcggccggtatgtggacgtcaccagcattctcaacaacaccggcaccgatgcgcacgattacgagccttcgaccaacgacatctccaagttccagcatgcgcaggtcgcgatactcaacggcgctggctacgacgagtgggcggcgaaggcggccggccagtccaaagcgatcgtgatcgacgcggccgccgcgggaggcaagaagaccggcgacaatccgcatgtgtggttctccgccgccgtacgcaacaagacggcggatgagatcaccgccgcctacatcaaactcatgccaagcgagaaggcggaattcgagaagctcaacaaggattggcataccgaggaggacgatctcgaagcgcagcttcagaccgtcgcgcaggccgacggcaagatgccgtacggcgccatagagtcggtgggcgactacctcgcgcaggacatgggcatgaccgacgtcacgccgaagggatacaagaacgcgacgagcaacgagagcgagcccacggcgtccgacatcaagagcttcaccgaggcgctcaagaagggcgacatgaagatgctgatcgcaaattcgcaggagaagtcccagctgagcgaccagctgacggacgcggcggactcgggcaacatcccagtggtcgacatcaccgaacagatgccaagccagtacaagacgctcaacgagtggctgaaggcgatcgccgagcagattcaggccacgcagaagaagaagtaatcggcgcgagcgagacaaatgcagctgcagtggggtggattgtctcgccaatctaccctcaatgagatgaatcaagttgtcatgaccggattcgtctcactgagacgctccatatgagacaaactaagttcctgcgacttggttcgtctcgctgacgcgctctaggtgagacaaacccggttctcatgacttggtttgtctcacccagccgctcaccctgagacaaaccaagtacgcagacaactcagcagattgtctggcggcaagcggctcacaacatacgataaggccccggatagccggggccttatttgatgcgattccgctgcggccgtcagagcacggccatgcagatgaagtcgagaatgaacagcgcggagacgatccacacgatcggatgcacctcgttggccttcttcttgcacaccttgacgatgcagtaggtgatgaagccgccagcgatgccgtaggagatcgagtaggagaacgccatgaacacggcggcgaagaacgccgggattgcctcggtgatgtcgtcccacttgacttccttgagcgaggcggccatgaggcagccgacgatcacgagcacacccgcggtcgcagcgctcggcacggcggagatgaccggcgcgaagaacgcggagacggcgaagcaggcagcgacgatgacggaggtcaggccggtgcggccgccggcggcgatgcccgccgaggattcgacgtaggtggtggtgttcgacgtgccgcagatcgcgccgatcgaggtggcgatggaatctgcgaacagggccttgtccatcttcgacgagaagccatggccgttctcgagcgactcctcatcggccttcgagaagatgccggtgcgacgaccggtgccgatgaaggtgcccagcgtgtcgaaggtgtcggacatcgagaacgcgaagatcgtcaccagcacgagcgggagcttggccgggtcggagaacagcgagccgaagccctcgccggtgaacagggcgccgaaggtctgcggcagctgcgagaaggtctcgccgagcgaaacggagttgctcatggtggtcagacccatcgggatgccgatgacggcggtgatgatgattgtgagcagcaggccgcccttgaccttgaggatcgtgaacacgatggcgagcagcaggccgatgaggaacagccacagcaccgggctgttgagcgtggccatgcccggggtggcgccggttgcgaggccctgcccggctgccttcgtgtctttcggggtgaaggtgatgaagttgacgttgagcaggcccacgtaggcgacgaacaggccgatgccgccgccgatcgcctgctggagcggttcggggatggccttgatgatcatcttgcgcaccttggtcacggtgatcagaatgttgatcagaccgcacaggaacaccatggcaagcgtttcctgccaggtgaagcccagaccgaagcacacggtgtaggtgaagaaggcattgaggcccatgccaggagcctgcgcgtacgggacgttcgcgaacaggcccatgacgagcgtgccgatgatggctgcgatgatagtcgccaggaagacgccgccccacggcatacccgtctgcgacaggatctgcggattgacgacgatgatgtaagacattgcgaagaacgtcgtgaggcctgccatgacctcagtggaaaccgacgttccgttttccttcaaatggaaaaacttctccatgagtaaccctgtattcttctcgtgaactcttttctgccgccccgccgcaaacgacaggacagctaaaaactagcacgggtgtgtaaaacacggtcgttacatgggcgcgttatgccacggatatgcccccagtcggccgcaggtctcccgcttcgtcggttgtccgcgttccgtggcgttcctcagcaagatgccccgcatccgcccagccccacggcacaggaacaaacctctctctcagccgaagcggcccgaaacgtagcgctcggcctcctcgttctgcgggttgttgaacatcgtcgacgtatcggcgaaatactccaggtgcccgggctgccccacggccttgaggttgaagaacgccgtatagtccgcgatgcgggcggcctgctgcatgttgtgcgtgacgatgacgatcgtgtagtcctgcttgagctcctcgatgagatcttcgacagcgagcgtggagatcgggtcgagcgccgagcatggctcgtccatcaacagcacctgcggatgcacggccacggcgcgagcgatgcacaggcgctgctgctggccaccggagagcccgatgccggggttgtcgaggcgatccttgacctcgttccacagattcgcgccgcgcaacgcccactccacgaggtcatcggcatccgacttcgagatcttgcggttgttgagcgacacccccgcgagcacgttctcacggatcgacatggtggggaacggattcggccgctggaacaccatgcccacgtcacgccgcacggccaccggatccacatcctttgcataaaggttcttgccctcgagcagcacgtcgcctttcacgtgggcgcccggcgtgatctcgtgcatgcggtcgagcgtgcgcagcacggtggatttgccgcagccggacggcccgatgaacgcggtcaccttgttcgcggcgatatgcagattgacatcctcgaccgcaaggaaactgccgtaatagatgttgagatggcgaatgtcgatttgttgtcccattcgtattccttatctaggtgtgatggtgttggcgtgctatttcttcttcggcgcgaacaccttcgcgacgatccgtccgatgaggttgaggatgagcacgatgacgatgagcacgagcgcggccgaccacgcacgctccatcggtatggcggtgacgcagccgctgccggcgtcggccgggcagttcgcatggtacttcgaatactcctgatagacgtacaccggcaacgtggtcatttcacccaagaacagattcgcgttcgtcgagacgatgtagccggcggtcatgagcagcggagccgtctcgccgatcacgcgggcgatggcgaggatggaacccgacacgatgccggaaagggcggtgcgcagcacgaccttcgtgatcgtgcgctgcttggtcacgccgagcgccagcgatgcctcccgcaggtcgttggggacgatcttgagcatctcctctgtcgtcttcaccacggtcgggatcatgagcagcgacaacgccaccgagccttcgaaaccgttgagcgtgccgggaccgacgaggatcgcgaacatggagtaggcgaacaggccggccacgatggacgggatgccactcatcacgtcgacgagcaggtggatcgtgcgcgcgagcttggatttgcccgcgtattcaatcaagtagaccgcgcacatcacgccgatcgggatcgagatgaccatcgcgcccagcgtgatctccaacgtgccgatgatcgcatggaggatgccgccgtagccgcccgacggcgtctggttgccgccgatcacgttcgtcatgttgtggctgaggaaatcccagttgagtcggcgtatgccatgcgccaatgtcgtccacagcacagagatgagcgggatgagcgcgacgacgaacgcgaggatgatgagcgcgcgcatcaccatgtccttgcgtttgcgcgcggcggtgtacgaacgcgtcggcttgaatttgtcgaagtcgatcaccggtgccgcatcggcgtgcggcgtggactgcggttcactcatcatttgctcgctttctcggtgatgcggcgtgccagcagattcacgaggaacgtgatcacgaacagcacgagacctgtgccgatgagcacggagacgccgatgctatcggcctcggggtattgcgcggcgatgttcgcggcgattgtctggttctgcgaggcctgcagcagtttgaacgagtatttgaggcccggcgagaggatcatgagcacggccatcgtctcgccgagcgcacgaccaaggccgagcatcgacgccgagatgatgcccgagcgggcgaatggcagcaccgacatcttaatcatctcccacttggtggcgccaaggccgagggcggcctcctcaagcagcttgggggtctgcaggaagatgtcgcgcgtgatcgacgtgatgatcggcaggatcatgatggcgagcacgagtgccaccgtcgccacggtgcgcggcgggttcgaggccgggcctgcgaagatggggatccatccgagatgctcggcgatccagttccagaacggatagattgccgggacgagcacaaggccgccccacaggccgtagatgacggacgggatcgccgcgagaatgtcgacgatgtagctgagcatggccgcgaggcgtttgggcgcatagtgcgagatgaacagcgcgatgcctatcgagacgaagaacgcgatgatgagcgcgagcgccgccacgagcacggtgccgaacagcagcgggccgacgtagccccagaagctcgtcgccttgccgccggtgaaactcgagatgacgtcgctgttcgtccgctggtctccgccgatgagcggccatgcgcggaacagcaggaacagcgcgactgcggcgagcacgacgaggatgagtatgccgcatgcgtaggcgatgccgcggaagatgcggtcggctttctcgccgctgaccggtttcgtcagcgacgagtctgcggctggctgtgcgggtggtttcggtgccgatgacatatgctcacttcacttccatggcgtctatggattcacgcacgtatttggcgatgttggcgggcaatggcgcggatccggtcgcgttcatcgcctgcgcctgcccttcctcgctggtgacgtagctcagccaggatttggcgaatcgcgccgtgttcgcatccgtgtaggcggggcatgcgatgtcgtacgagaccagcacgatcgggtaggcgcccgtcacgcgggtcgtatggttgatgtcgagcaccacacggtgtttgccaggaacggatttgtcgagtgtggagtcggcgactgccttcgaggcggcctcggccgagatcacggtaggggtgtcgcccacctgcaccgcgacggttcccatgcctcccgcctgggagaagtccgcatagccgatggtgccgttcgcctggtcgatggtgctgatcacacccgaggtgcctttggcgccttgcccgacgtcgttgggccagttctccgaaagctcgtacggccaatcggccggcgcagccgccttgatgtattcgaggaaattgagcgtggtgcccgatttgtcggagcgatgcacgacggtgatcggcagatcgggaaggctgagtccggggttctgcgccgtgagctcggcatcgttccaccgtgtgattctgccgtcgaacaccttcgcgatggtggccgcatccatgttgatgtgtttgccggcatcggagacgccctgcagattgaacacgatggcgagcggcgagatgtacaccggcacgtcgaacgcgcttgcgccggcgcataccgatgtcgactcctcgacctgtttggcatccagtggcttgtcagaggcggcccatacggtcgccccggtgaggaatgtggccacgccggcacctgagcccgacggattgtaggagattcgcgcatccggattcgtcttctggtagccggccacccatgcctcgaccgccgtttgctgcgaggaggcccctgctcctgcgaaactgcctgagatcgacgaggcgttggcgaccgggcgattcgccggatcggtgttgtctccgcacgccgtggtcgtggcaatgaacgccatgccgcacagtgccgcgagcacgcgccgtgcaagattgctacgcatgtggtttcctttggtcacgatgccattgtatccaaccaattcagtgtagaggagggtggggagtcgtattgaggcgaacggtgaatttagcgtgaacgttcgtcgcagattctgtacccgagaccgcgcaccgtcgtcagcagtgccggattcgacggatcggcctcgatcttcgcccggatgcgcttgacatgcacgtcgagcgttttcgtgtcacccacgtaatcgctgccccagacgcggccgatcagctgctgtctggtgagcacgcggcccttattgcgcatcaggtattcgagcacctcgaattccttgagcgggaactgggtcagttcaccgtgaatgcgcacttcgtgcgaggccaccgacatctcgatgggcccgcatgtaagcgtctcatcgttccctccgggtgttccagaagcccgtggctcgagactgcgacgcaacaccgcatggatcctggcgagcagttcgcggaaggagtacggtttggtcacatagtcgtcggcaccgatttcgagccctacgatcacatcattctcggttgatttcgctgtcaccatgatgatcggcacacggcgcagctcgtgcatgcgcctgcagagtgtggtgcctgagatgccgggcagcatgaggtcgagcaacacgaggtcgaactccatctcctcatacagctcccacgcctcctccccggtggcggctccatgggcctcgtacccctcacgggtgagctggtagagcaatgggtcgaggtaggaaggttcgtcttccaccacgagaatgcgcgtcatctgtcggcctccttgcctgttccgtccggatcgccctcggcatccgcatcccgattgcatggggtgtcatcgtctcgcatcgccaacggcaacattaccgtgaatgtggacccctcccctggtttcgaccatacctcgagtttgccctgattggccagaatgtgatggctggctattgacagaccaagcccggtgccgcccgtcagccgcgagcgcgccgggtccacccggtagaaccgttcgaaaatgcggccctgcagttgccggggtatgccgatgccgtgatcgacgacgcgaatgcgagcctggtcttccccgcgggagacctccacagtgacctcggcatgttcgggtgagtagttgatcgcattctccacgaggttcttgagcgcgatatgcaccgccgccgcatcgaccgtcaccggcagcggatgattctcgccggcgtcatcgcgcatgcgcaccatggtatggcgtgcccctgcggtgacctcggtgtcgatgatcgcctgccgtacgagttcccgcgcatccaccgtgcgtcgcgtcgtggcccgatcgccgtgcatgcggccgagttcgatgagtctgcgcacgaggccgtcgagccgtttcgcctcgacaccgattctcgcggcgaaatggcggatcatgtcgacgtcgtcgccggcatcgtcaatcgtctcggccagcagcatgatcgcgccgaccggcgttttgagctcatgcgacacattggtcacgaaatcacgccgtacgcggtccacgctgcgtcggtacccggtgtcggcacagaccaccgtcacccgatcgtcggccgtgcactgcgcggtcacggccacatgcagccgctgcgaatctcgggcgagttcgagctcccgttccaccgccgcgtcggattgcgccgcctcctgcacgagatcgcgaatgccggcgtccacgatcagaccgtccacgctcaggccacgttcaatggccgcctcattcgcgacgagcacattggcgctggaatcggtgacgatgacggcctcctcgagcatcgcaagcatgcggcgttcgccatccacggcatcggcatcggcatgcccggcgaacaacgcggcctcactgggctcccgctcgcgctcccggttgcgaccggcacggtaggcgatggcatagcccccagctatgagcagcacgcccatggcaatcgccatggcaatctcacctggtgtcatgacgcccttccatcgcgaaccggtgccccattcacatcccgcgcagaatccgcacaacgagacgggccgccgtatcggcgtattcggagatgtcgaagtccttgaactcctcgtagtcggtgtcggcagagtcactcatggcgcggatgacgagcgccggcacgtcgttgcgcgcggccacatgggcaacggccgcgccttccatctcgacggcgtccgcatgcgtctgttcgatgacctggctcaccttctgcggcgtgtcgacaaagtagttgccggaggcgatggtgccctggatgtggttgatgcccatctcgtcaagggcgccctcggcgatctgaagcagtgccgggtcggaatggaactcgctggtgcccggcttccactggcccaccaggcgcatgtcggtgtcgaggtagcgcagcgtcttgccgagcacaatgtcgttgatgtgcaggctcttgttgaggttgccggcgatgccggagaagatcacggcctcgggatgcaccaggtcaatgaggaactgcgtggtggcggccgcgttcaccaaacccatgccgcccacggtcacggcgacgtcgagttcctcccccgcatcggtcgtcaacgtgccccgggcgacactgaggctcgcacgctcggtcacggtcatgttgtcaagcgagtccgcgatatgtgcggcttcctcgtcgagggcggaaatgatggcgacggtctgcatggttctccttcgctgcaagcgcatacggcaatcgatatcacccgaatatactccgcggttggaacgcgggcggctgcgtcagcggttccagcggcgggtgcgcacggcatcggcgagcgtgtgcagcagctcgtcggtgaccggccagctcaggcacttgtcggtgatcgactggccataggtgagttcggcgagcggtgccggcgcctgattgccccccacgatgaaactctccatcatcacaccgctgatgccccgctcgccgcctgcgatgcgttcggcgatctcgcgcaccacctgcgcctgccgcacgtcgtccttgccggagttgccatgcgagcagtcgatgacgagcccatgcgaggcggccgcctcgtcgcccatcttgtcgcgaatggaggcgagcgcctgcgccaccgattcggcgtcgtagttcgggccggagctggaaccgcgcagcaccacatggcagtccggattgccgagggtctcgacggcgcaggctcgcccgcggtggtcgatgccgaagaacgtgtgctggtcctcggctgcaatgcaactgttgacggcggctttcaccgagccgtcggtcgcgttcttgaagccgatcggcatgctcatgccgctggccagctggcggtgcacctggctttccgtgttgcgcgcgcctatggctccccagctgaccgcgtcggcgatatactgcggactggtcggttcgaggaactcggtggccgtggccacgcccgcgccaagcacatcgagcaaggtgcgtcgggcgagcagcagccctttctgaatgttgtgcgagccgtcgatgtcagggtcgttgatcagccccttccatcccaccgtggtgcgcggtttctcgaagtacacgcgcatgacgatgagcaggtcctccccgagttcatccttgagcgtgcgcagacggtgcgcatagtcgagcgcggccttcgggtcgtgtaccgagcacgggcccacgatcaccagcagacggtcgtcctggccgtacaggcaggcgcgcacctcgtctcgcgaataggcgacgatgtcttgcatctgccgggtgagcggcagttccgcgagcacctgcgccggtgtgggcaacgggtcgagttcgagcacgcgtcggttgatgatgcggtccacgccggccatgtcttcccatctgggcacattctcgagcaccaccagcggattcttgcctgcggcgatggcgtgctgcacctggcgcatctgctcatgcgtgtaggtgaggccgttcccttgcactatggcgtccttctgctccttggacatcggctcgtacggattctcgctcatgttcctcctcactgtgccacaatatagcaaatccgcggggaatgcgcgggcgtgccgaatggcggcgcgcgctcatgcgcagaacgcgttgaggaacatctgcaaatacgcctgcatgccgagttggttggggtgaatgccgtcgtcgtacaggtagtcgtcgcgcccctgtgacgtgcccgaccagtcgatgatgcccacattcgggtttcgttccgccatgccgatgaacgtggcgttgttgccgggcacccagtcgaccggcgcgcgcgtcgtcgcgaaatacagcggtctgccgcccgcgaggtcaatcacctgctgcgccatctgctcgctcaccggaccgttcgtgccgagtgcgaacacgatgacctgcggatccatgccgcgtgcgagatcgtcacgcaggatctgcacgccttggtcgaattggcgactcaccgcaccgtcgatcgtcgcgttcgggaaatgctcacgaagcgtgtcggaaaccccttcggtcaccgagtcgccgatcatgagcaccttcgcctggcagaccattgccttgcggtcgcacgcccaacgctgcggctccagattcgccggcaccttgagcgccttgaccaccggcggcgccactttgggcttggcctgcgcattcggcttgccgctcgagtccttgtgctctttgccgttctccttactggtttcagattcgcgcttctgctgctgcgcgagccgttcacgcgcctgctcggcggtcagcgcgagctcgggacgcgccttgacggagcgcgcgtgcgcaatggctcgccagtcgagcggcagggccatgacgaaggtcatgacgacgccaacgatcgtcagaatccatgcgctggtgcgcaatctgcccgcacccacggaggtgatgcggcaacgcatccacggcagccacggggtgcccgtcagcgcttcgacaatctggtagaacgcctcgcctgccataagaatcaccaggaactgccctatccactcataccagggtatgccggtggtgcgcgtggccgggttcatcacctcgagcagcgggtagtgcaccaaatagagcgagaacgaacgcgaacccaagtagcgcaacgccttcacaccgagtatgcggccaacccgtgcatcctgcatgctcgcatacagcagcacggcactcaccaccgcgaagaacaggaaaccgccgtggtacatccatgcggcacgggcatccaccagcaggaatccgagagccaatgccagagcgcagatacccgctgccacaacgcccagatcgccacgccgcagcaccgcgtgatatcggccaatctgtctgtcgaacacgattcgcccgtcggctgcacgccgttcctgatcactgcgcgaggcgctgtcgtgcacgagcatggcgagcagcacgcccacgagaatctcggcggcacgggtgtcgagtccgtaatacagacgcgaggtgtcggcctctggccggtatagcatcatcatctcgagcgtgccggcggcgatgagcgcgcccagcacgccgacgcgcacccagtgcctgcggcagtgcaggaacagcggaatgaataggagcggccacagcaggtagaactgcatgatcaggctcgtataccacaggtgcgtgagcggcgagggcaagccggccgcatcgaaatacgagagcttgcggaaaatgaacgaccagttgctatagaacagtgcgctcggcacggcatcgccgcgcatcttcagaataagcggcggcgcgcaggcatagacgagcacggcggtcagaccgatcgtcgagatcaccgccggccacagccgcttcacgcgtctgcgcaggtagtcgaacagcaggaagcgatggccgtccaccgcgttcatgagcgaacgggtgatgaagaagccggagacgacaaggaataacgtgacgcccagaaaaccgcctttgagcagcatcgggcgtgcatggtaggcgatgatcgccacaatggcgattgcacgcaggccgtccacgccgttgaaatggcgcgcctgcgcaacgccgcgtggaacatcgcgtgaaacttttgtgccggcggccactggaagatcaggcgcgttcgaagcctccccctccaccgcacgcggcgcccggggagtgtgatcgtgctgtgccgcccggtcgatcgcaccggccggcgtagagcccttacgagcaaagaacctacgcatattccctcatatgacacgagtccgattccccaccccacgcgcgggcatgcctcacgcgcgatgtgaatggaaactgtcacatatactaccgtgcggcacgacgcgcattcacggcctgggcgagcttacgcaacacctcttcgctacgagcccacggcacacaggagtccgtaatcgactgtccgtattcgagttgcgccaacggcgccggcgcctgatgaccgcccttgaggaaggattccatcatgatgcccaatattccacgttcgccaccggcgatgcgttcggctatgttctcgacgacggccgcctcgaccacctcgttcttgccgcagttgccatgggcggcatcgatgatgagcccatgcttgctggggccttccgccttcgattcatgcaggtcgcgcaatgccgcggccaccgactcggcatcgtagttcggcccgtggttggaaccgcgcagcaccagatggcagtccgggttgcccttcgtctcggcggcgatcacatggccatcgaggttgatggaaaggaaatgatgttcgaatgccgccgtgtagcaggagtcggcggcgggtttgaccgagccgtcggtcgcgttcttgaagccgatcggcatgctcaggccgctggccagttcacgatgcacctggctttcggtgttgcgggcgccgattgcaccccagctcaccaagtcgcacaggtactgcggggtgatcgggtcgagccattccgtggccgcaggcagccccatacccaccacatcgcacagcaccttgcgggcgagccacatgcctttgcgaatatcgaactcgccgtcgatgtcgggatcgttgatcaggcccttccagccaatggtggtacggggtttctggaagtacacgcgcatgacgatgagcagatcgcgtttgagctcatcggcgagctcggccagtctggtggcgtattcatgtgcggccttcgggtcgtggatcgaacagggccccacaatggcaagcatgcggtcgtcacggccatgcagaatgtcgcggatctgcgcgcgctgctcgagcacctgcttgcccatctgctcggtgagcggcagctccttgatgaaatagcgtggcgcgggaatcggatcgagctgacgaatgttcacatcgacggtctcgggcaccaccgcattggcgtcaagcaccgaatcctgtgagctgtcgggccctcgcatcgcagccatcgctacctctttcctcttccttccaattccggcgaataactgtccttatattaggcgtttgcccaacaccgtgcaaagcgatgttgcagaatggacacatggggggcaagaagcggttcatgggtggaacggcttcgagagggaccgatggcggggcgggaggcgctcgtcactggatcgcaagcgcccttgacgttcctcacacctcccgccccgccatcggcccctctcggcattgccacgccatcaatgcatccgtttcctcccaggggaagctcgggacaacaacgtttcagtcgggctgccatgtgagcgaagcgaacggcatgcccccgcgcgctgcccgtttggctgaggaacgtcaagggcgcttgcgatccagcgacgaggccaaacgggcagcgcgcgggggcatgcctgaacctttcaggtcaagtcccgctgccgagcagcgacggaagaaaggagaacctaggcgagggcgcccatcggatcccaggccggcagcatctgggccggctcgtcgagggccttgaggtactcgtcgggcagcagcgccttgggcacggccacctcgaacacgtactggtcgaaccagtcgtcgcccatcgtgaagtagcccttgtcggcgatcttcgtgccccacgagttctccacgcgccaacggcgggtggtcttgttgtcatcggccacgtcaacgcccacgaaggccattgcatggttcatcgcggagtcggcgaagcgcacacgctcctccttgtccatcgtgaagtcgtagtcatacaccttgccgtactcgaacaggtcggtggcccaggcgccgtcctcacggtccatcatcggatggcagtcggctccgaaccacaccggaatgccctgctccaccagtacatcgcgcgcgcagtccttcatgaactggatcggcacgttgaggtattcggtcgggtcgccgccggccacattgttgaggtgctcgatgccgatcttcttgcccttggcgtgctcgtggcgcggatcgtcgacaaggcagacgtagctctccagatcggcgtcgcccacatagcggttccagaactcgaccggcgtgatctcacccacgcggtggaattcgccgtccttgtcggtccactcccagtcgaagctcttcggcggctcgcccaagtggatggtgagaatgcggtggccggccttcgtggcctggagaatgatctcgtcgatgtgctccgggctcttctccatctgggagacggcggtgtgcagcatgcggcgcagctgcgtgtcgagttcgccggtgttcttcgacgattcggtctccgggtacaggtccttcggcacggcgccgtacttcttgtacacgttcatggccatggtccactggccgccgtcgcccatcacatcgtgcagcatgtgctggaacagacgcgagtcggtcggctcgccctcgcggatcaggttcgcgatgtcctgcaggaagtagttgacgcgctcgagcttgtcgaagtacatcgcatagttctgcgagaactcgaattccttgatgttcatggtcttcttggccacatagcgcgccacgttgagcgagctgaacagccagcagcggcccgagcggtcctgatgggtggcctcgccgttgtcgagcgacgtggagaaacgacgctgcagcaggcgggcacggtcgtagttgcgcgccaccttgttgattcctgccgcggtcacggcgttcatggccatcacattggacttgctgccttcgaattcgctggtgagatcatcgagatcatggctgctcagtgggctgatcttgtcgctcatatgctcctctgttccactcgtctgcttcgtatgcttgtgattgttcttcttgcctggtaccggctgtctgccactgtactcgcatatgagaaaagtcgcgcagagtgaatgccggaatactccggccgctctgcgcgactatgcaatcggatgatgatgtgcccgtttggttttcgcgggtcactgctcgttgttcggcgccaccggcatgttgtcgctcgaatcgaacagcgaatccgcgtcgccggtcacatgggtgtcgtcactgatcggttcgtcgccgtcaatggcctccatcacctcggctgccgacgcagcgggagcctccggtgcctccggggacggcgtgttcggatccgctggaatgtccaccgccggaacctgcgcctcatcgttcgtgccggcgttgtcgtcgtccgccgcgttcgcctgtgctgcgtgatcgtggagggccggggcgaccggcaccgtgacgtgcgacatcgggtgcgaggcctcatgctgagccgaatcggagggattgatgagcatggtgttcgccagatcgctgcgaacgctgccgttgtcggccggggcctgcggagtgtccgaagagtcgttgtcgccagcgacggtgttgaccaccgacatcgtgtcggtcgaatgcttgtcgatgccgaagccgaagcctgcaaaggcgttggcgaacatggagcgcagttcggagacgcgctgcgtgatgtctgcctcacgggtctgcagttcgccgatgcgcttacggagcccatcgagctcggattgcgccgccttgcgacggtcctcgatctgcttggaggcctcctcgccggccttgcgcacgatctcacgggcctcggtgtcggccgactcgcgcttctcggcggcgtaggcgtcggcctcctcgcgggcctgcttggcctgcccgatctccttctcggcctcctccttggcgctcttgcggctttcctcaaggctctgcagcagttcctgcaccttcttggtcgcctcatcctgctgggcggcgatgtcggcgcgaatctgctccacctccgcattcacctggctcatcgtctgcgtgcggttcacctcggcggcatcggtgatctcctgcgcatgcgccttggcggcatcggtgatctcgccggccttgcgctgcgcctcggtcatgagtttcgacacctgctcgcgcacatcggccagtttcttgttggcgtcggcgagcgcggtctcaatctggtcgttcgtctcgctcttgagtcgcgccatctcctcgttcgcgcttttgcgctgctcggagatcgtcttggcggtctgtgcgctcagatccgcgagctcacgctcctgctgggcgcgttcggaggcgaggcgcttcttgtgctcctcgcgcgagttcgtcagctcgaggtcgagcgcctgacgctggtcgctcaccgtcttcgcagtggaggcgcgcagctgctcggcttcctgacgggcgttcgtcacgatggtgttcgcctcgctctgcgcgttcttgagaatggtgtcggccttcgcctgcgcgtcgtcgaccaggtgctgggcgtcgagtttggcgttgttcacgagcgtctgggattgcgactgcgcttccgtgcgcgcggaggccgcgtccttcttggcacgttcgagcagctcggtgctcgtctgctcggcggaggcgagcatctgctgggcgttggcgcccagcgaggcaaacgagttgtcggtgttcgccttgcggttcttctcctcctgcagttgcgcctgcagctgcagcaccgtgtcgtcgcctgccttcacctgttcgcgcaaacggtcgatgctgttctgtgccgccagcatcgcctcgtccacgcgctccttgtcgtagccgcgcagaactaccgggaaacgatccaccatgttcaaacctttccgattgccgaatgcaaacgcatatataactgcactttaatgcgtcggtccgcggaaaacgcgcagacgtccgcaaaaatcacattgagcgtatgttttgcagattaccccacagacatgcggcaatctgcaggtgagggcgccgactatgcaatgagcgtgttcacgccgatcggtttgacatagtagcgtgcggtctcgcggatcacgtcgcggccggcgcgaatctgctggtcgagcgtgagcccatgctgcgagtgttcgcgctcgtccacgggcggcagattgacgaagccgctcagcgtgcgaccctggcgcgatgcccagtcctgcagcttgtagaacagcgcgttgcatacgaaggtgccggcgttcgagctgagcgatgccggaatctcgtcggcggcgaacgcaccgagtatggcgttcaacggcaacccggtccagtatgctgcggggccggccgcattgatcacatggtggctcggcaccttgttgtcggcgtccggccggttcgtgtctttgacgttgatggcgcagcgttccagcagaatgccacgggacgcccgcttcagaccggtcgccacgacgatctgcggacggtgctcctcgagcgcggcctcgagaatcggccacgccttggagaaactgaccggcatgtgcacggcgtgcacggtgatggcgacgtccttgaggtcgtcgtcactgtccattgcgccgcccatgccctgttcggcaagggtgtccggcacgatcagcgccggattcgccgtcacatcctcatacgggtcgaagcccgacatcaccaccgatagttcctgcatgtcactcgccttcgacgccgaatgccttgccgaacatggcatgcagctgctccttggcggcgcgctgccgttcgttctgcggcccgcgcggggcgccggcaagcgcattcgccagcgcgcgggcaagcggcatgtcgtcctgcgtggtcaccttcatgttgcgcggcgatccgccgacgatcgcaaccggctggtcgggcagatagtcgacgaccacgcgggtgtcgtcggtgggccggaaatccgggtcgccggccgccttcgcataggcgtcgcggattgtgccgaagcggaaggcctgcggggtctgcgcgcggaacgaatggcggcgttcgggcaccgactggatcacctcgcggtcacccaggtcttgtgtgagcagaatcgtgtcggtggaggggcaggccacggtggccgccgtgaactcgtcgagtgcgtcgatgcagccgtcgatctcctgacgggagacgaacgggcgcacggcgtcgtggatgagaatcttggcatcctgcggaatgccggcgtcggcgagcgtggtgagcgcggcctcggtggaatcgctgcgctcggcgcctccggtgatgatcgcgcgcaccttggcgtatgaggcatcgtcaatgagctgctcgacggcctcacgcacggtgttgttcaccacgacaacgatgtcgtccacatgctcgtcgttctcgaatgcctcgatgctccatgcgacgatcggcttgccgttcaatgccaccagctgttttggctttgcggggtcgaaacggacgcccgagccggcggcgagcacgacggcgaccacggggaccttggtttgctgagtcatgttgtatccaatctgtgtatgaacattcaggaacgcacaatgagcgccagcatgcggccctcatgcctcttgtgggcgagttcggcgcggcgatgcgagaaccacagcgggttctccagcgtgcacatgctgtagcgaatgcccttgatgcgctcctcaagcgccgggtctccctcgttgtcctcacggcacagctcctcgagctcggcgtcttgcgacaggtactgcgtggcggcattgacgcgcggctgcgaggagaagatgcggtcgtccttgatcccggcctggtgcaactccatcagcgccgccttgttgaggtcgatgccggggccgccgaagcgggtcagcgtgaaggtgcccgggaactgcgcgtcgaattcgtcggcgatctggtcgcccacctcgtagcaatcgccgcagatggccgggccgagcgtggcgacgatgttctccttggaggcacctttcttcaccatcatgtcgacggtggcggcgatcacattgcgctgcaggcccttacgcccacagtgtgcggcggcgacgaccccggcctgcgggtcggcgaacagcaccggcaggcagtccgcggcgaacacaccaatggcgatgtccttgcggcaggtcacctgggcatcgccctcgatcacctgcacttcggcgttctcggactcaacgtcgtccaccaccggctcgcccgcacgcttcgccttggcctgggcctcggtatgggaaccggatgcgtcgaaaccgaacggcttgttctcggtatagacctcgtcgatgtccaccgacttgcccgaatgcacctggtcgatgagcgagagcttcacatggagttcgtcggcaagcgcctcgcggttgcgctccacagcaacggggtcgtcgccggacttgcctccaagattgaagtgcgcccattcctcggcgctcacgcctcccagacgggtggtgtaaatgacggtgatgccgggcgagagcaccaccggaatcgtcactggaatcgggttgccctcgtcgtcggtgggttcgatggccgagctgtcgagaatggcatcgtcataggtcttgccgtcggcgtccttccccccttcgcgtgcggccttgtcttcctgctccacggtcttctgcccatgcgcctgcaccgccttgagcaggtcatcgagattgatctgcatcggcttgggtgccgcgttcgcgttctgttcatccgtatgctgttcttgttcactcatacgtcacacaatagccgccaacgccaaccgcacaagcgccttcagctctggtctaagcatcctgcgcccctttgcacacatcctgtcgcgtcttcctgcggccactttgcacagttcggctcgaaaatgtcgttgaggcacgttcctcaccggccgaatcgtgcccacctgcacgaaatgaccgaccgacgagccggaccgaaagcatcttcgacaatcctgccccacccattgacctctttccgcattgcagcgcaaaatggccaatgggcagcgctgtccgtcggccaatctgcgcccaatgcacacaatggccaacgagcagcgctcactccgccttgagcgtcggcttcttcgtgcgcgagcgcaacgcggcgttcaccggaacctccacgcccaacggcaacgagaacacatgggccggattgttcaccatcggcacctcgttgccgtcggcgtcgcgtatgccgccgtccggtacgacgtactcgagcggcgcgcgcccgggcagcaggaactcgacgagctggcccggttccatcttgttacggctcatgatcgtcacgcgaccgccctcctcgggactccacgagagcacctcgcccaccacgagccaatcgcggaagtatgcgctgcgatcggtgttctgcgtcaccttctgctccgggtagtagaaaccggtgctgtaatcgcggtgcgccaccttgtacggctcctccatgagccattgcggcaactccacatgcggtgccggtcgcacaggtgcatgccgccatccgtcgtcggactcctccacgagctgcccctggcgcttgagaccggttctgcgcgcctggcggttcgagatcccgccggcctcgccttcgtcgttcgcgctgtcccagttcggcatgccggcgaacgcggcgtcggcattgagcatgatcgtgtcgcgtgcggaatctgcaaacccttcctcaccggcgcgcaccacacggtcatggaacggcttgagctcgttgcccgcttcgtcttcgaacccgcgctgcaccatgtattcgttcaccgcggtcttgtacgcgttcgtcatcgcagccacatagtacgcggacttcgagcgcccttcgatcttcaacgacgtcgcccccgaatcgatcagatcgtcgagatgcgccatcatgttcatgtcctgcgaattgaacagatacgtgccttgcgcggtctcctccaccgggaacacctgcccgggccgcttctcctcgacgagcgagtatttccaacggcacggctgtgcgcattcgccatgattgccgtcgcggccggtcaggtagttcgagatgaggcagcgcccggagaacgccatgcacatcgacccgtgcacgaacgtctcgatgtctaagtcgtcgggaatgttcgcgcgaatgtcgcgcaccgcctgcaaatccatctcgcgcgcgagcaccacgcgacgcgcaccgaggtcatgcaatgcattcgccgccaggtaattcgtcacaccggcctgcgtgctcacatgcagttcgagttcgggcgcgatcctatgcgcgagcatcatgacgccgatgtcggtgacgatcagcgcgtccacgccggtggtgcgcagatcttcgatgtaccgttctatcgccgtgatctcgttgttgcgcggcagaatgttgagcgtgacatagacgcgcgcgccgcgctcatgcgcatacgcggcgccctcgcggaagtcgtcgaggctcagattgcgcggcgccgaacgcatgccgaacgacttgccgccgcaatacacggcgtcggcgccgtaatcgacggcggtcttcaacccgcgcagattgcctgccggcgcgagcacctctggtttgccacgacgtttcatgccaccacacttcgcttggattcacgggaatgcagaccacatgggatatgcagaccacacagtatagcgggcggcacagccatgccccgtctctgggaacattccgtatgccgtgccgtctccagaccgttccgcgacccatttcacggaaccttcctaacaaccgaccgcaaagagggggcatctgcggcacatcacacggatgcttccgcgaaacgaaccacaacgagacatcaaaacggcacgccacacggaaattccgcgcaacgtgccgcatgacctatgccgaacctatgccgggcgcccggactcagccgagcttggcgagctcctccggcgtgagttcgagatcgccggccttgagcgagtcgagtatcgtggcggggcggtgcgcacccggaatcacgaacacgtggcttcccttggcgagctcccacgcgagcacgacctgctggtagctcacgccatgcgcttcggccacctcgcggaacgggtcgaacttcgactcgtccttcggcttgcggaagccgccgagcgggctccagcacacgaagctcagccccaccttgccgcagtagtcgagtgtgtcggctgtctcggtgtagatcggcgagaactggttctgcacggcgatcagcgagtcgccgagaatctcgcgcgcaatgtcgatctgctcgatggacgcgttcgaaatgccgatctcgcgcgcgatgcccatggagcgaatctccttcatcgcctcgcatgattcgccgtacgggatcttcgggtcggggcggtggaagtacagcaggtcgatcatgtcgacaccgagttcgaatgcgctctgcttggcgcgtttgatcaggttctccgggctgccgtccacatcccaggtgggtttgccgtcggtgaagttgcggaagtgccccaccttggtggccacgagcacttcgtcacgcggaccgtcccagctggcgagcgcctcgcgcacgagcttctcgccggtctgctcctcgcctccggagcagtagtacgcccatgccgtgtcaatctggcggcaacccgcatcgagtgcggcgtgaatggtctccacacccatctttggccccagattgttctcgatcgtcagcggcatctcgcccaagcctatggccgtggtgtcaaacgggcccagattcctatgcaataccatgctgctccttatctgctaccggtgtttccttacatggtatgcgcgcgcgggaacagactgcgcctcacctccgacacacccgggcatgctggcggcgaacatgacggcgtgccgtgtgggaaatctcacactcccgacagccgcgcatccacactccgcgcgcaacacgcgttgaaacacgcacgcagcgggcgctttgtggcgttcctcacacaccgaaacactagatgtagtggttcactgcaaactcaaacacaaggtattgtttttggcagacgtacccacccatgcacagcggaaggaaccgaatgcacatcaccatctattcgaaaccgaactgcccgcagtgtgcggccaccaaacgcgcgttcgacagactcggcgccccctacaccgtcgtcgacatcaccaccgacccggtcgcgctcgccacactgcaggaagccggtttccgtcaggcgccggtagtgttcgtggactcggacttctggaccggctaccgccccgacagaattcgcgatgtcgcacgcagactgcagacggtctcctcagcgagcggcgtgctcgcatgagcgccgttgtctacttctcgtcggcgtcgcgcaacaccgaacggttcgtggaacactgcgatttcccctcgtgcggcgtcaacgtgttccgcataccgctgcagcccaatgcggcaccgctcaacgtgcgcgaaccgtacatcatcatcgtgcccacctatggcggcggcgatgcgcgcaaagcggtgcccccgcaagtcaagcgcttcctcaacgaccccgcgaaccgcgagtggatccgcggggtgatcgcctccggcaacacgaacttcggggaggcgtacgcggccgccggccccatcatctcccgcaaatgccatgtgccgctcatgtaccgcttcgaactcatgggcacccgggaagacgtccatgccgtgcgcgagggcgtccgccgcttcttctccgatacccccaccgactgaaagaccgcaatgaccgcagactaccattccctcaatgccatgctgaacctctacgacgaggacggcaacatccagttcgacaaggaccacgaggccgtggatgccttcctcgccgaacacgtggccccgcgcatgatccgtttcgaaagcacccgcgaacgcctgcgctatctggtggaccaccactactacgaatacgacgtgttcagcaaatactcccccgagttcctcgacgcgttctatgcgcatgccgacgcattgccgcaccgtttcgagacgttcctgggcgcgttcaagttctaccgctcctacgcgttgaagaccttcgacggcgagcattacctggaggacttcccgcagcgcgcggccgccgtctcgctcgcgctggccgacggcgacgagccgatggccatgcgcacgctggacgagatcgtgctcggccggttccagccggccacgcccacgtttctcaacctcggcaaagcgcagcgcggcgagccggtcagctgctttctggtccgcattgaagacaatatggagtcgatctcacgcggcatcaacgcggcgctccagctgagcaaacgcggcggcggcgtggcattgctgctgagcaatctgcgggaggagggcgcgccgatcaagcacatcgagaaccagtcgagcggagtcgtccccgtgatgaaactgctcgaggactcgttcagctatgcgaaccagctcggcgctcgccaaggtgccggcgcggtgtatctgcacgcgcatcaccccgacatcctgaagttcctcgacaccaagcgcgagaacgcggacgagaagatccgcatcaaatcgctcgcgctcggcgtggtgatccccgacatcacgttcgagttggcgaagcgccgcgagaagatggcattgttcagcccgtacgacgtggagcgcgtgtacggcgtgccgttcgcggatgtcaatgtcactgcaaaatacgaggagatgcttgcagacgaccgcattcgcaagaccttcatcgacgcgcgcgagttcttcaccacgctcgccgagatccaattcgaatccggctacccgtacctgctgttcgaagacacggcgaatgcggcgaatccgattgacgggcgcatcacgatgagcaatctgtgctcggaaattctgcaggtgcaggaaccgagcacgtactacgaagacctgagctatgcgcatgtcggccgtgacgtgagctgcaatctcggttcgctcaacattgcgcgcgcgatggacgccgggctcgccggtccggtggagacggcgattcgcgcgctcaccgcggtctcgcagcacacgcatatcggcgcggtgccctcgatcgcccgcgcgaacgaggaggggcatgccatcgggcttggtcagatgaatctgcacggcttcctcgcccgcgaaggcatacggtacggttcaccggaagcgctcgatttcacaaacatgtattttgagacggtcgcgttccacgcctaccgcgcctcgcatgccctcgccgtcgagaacggccacgcgttcgcgcgcttcgccgactccgcgtacgccaggcagcccagcgacggtaattacttcgacaagtatctcgacggctccctcgacaccgaaccgcgtaccgggaccgtgcgcgcactgttcgaacgcttcggtgtgcggattcccaccgcacgcgactggcgcgaactgcagggcgagattctgcgcgacggcatctacaatcagtatctgcaggcggtgccgcccaccggatcgatctcgtacatcaaccatgccacgagttcgatccacccgatcgcctcgaagatcgagattcgcaaggaaggcaagatcggccgcatgtattacccggcgccatacatgacgaacgacaacctcgacctgtacgacgacgcctacgaaatcggatggaaagcgatcgtcgacacctacgccgaggccacgccgcatgtggaccagggactctcgctcacgctgttcttccccgacacggtgacgacgcgcgacctgaacaaagcgcagatctatgcgtggcgcaaggggatcaagacgctctattacatacgcatccgccagcaggcgctcgaaggcaccgaagtcgccggctgcgtcagctgcatgctctgacgggcacgcattcgccgaaatttattgaaaggatctgtcatgccaaaactcatcgaccgcgttaccgccatcaactggaaccgattggatgacgagaaggacctggaggtctgggatcgtctcaccggcaatttctggctgcccgagaaagtgccggtttcgaatgacattccggattggcggcagatgagcgacgccgagcacacgctcacgatgcgcgtgttcaccgggctcacgctgctcgacacgatccagggcactgtgggcgccgtgagcctgattcccgacgcgctcaccccgcacgaggaggccgtgtacacgaacatcgcgttcatggagagcgtgcatgcgaagagctattcgtcgatcttctccacgctgtgctccacacgcgagatcgacgaggccttcgactggagcgaaaagaacccgcacctgcagcgcaaggcgcagattgtgctcgactactacgagggagacgacccgctgaagcgcaaggtggcgtcgacgctgctcgaatcgttcctgttctactccggcttctacctgcccatgtacttctcgagccatgcgaagctgacgaacacggccgacgtgatccgactgatcattcgcgacgaggccgtgcatggctactacatcggctacaaataccagaaaggcctcgagatggcgagcgacgccaagcgcgctgagatggagacctacacctacgatctgctgaacgagctgtacgagaacgaggtcgagtacacgcactcgctctacgacgaggtagggttgtccgacgacgtggagaagttcctgcactacaacgcgaacaaggcgttgatgaacctcggctacccggccctgttcccgagcgagatctgcgacgtgaacccggcgatcctggccgcgctctcgccgaatgccgacgagaaccacgacttcttctcgggttccggcagctcctacgtcatgggcagggccgaggagaccgacgacgacgattgggacttctaacggccgccgaatgagccgccgcccgaaccaccgccggagccgccgaaaccgccgccaccgaacgagccgcccgaaccggagcttgacgaaggggccgcggaacggattgtggactgaatcgacgagaagcccgaattgagctgcgtgccgatgtccacgaatccgccggcgaaaccaccaaacgagccggtgccgttggcgagcgcattgccaatgcccgaaccgacgatcgtcgacggtctggtggaccagtagagcaggccgagattcgaggcgttcgaatcgagccaatcctgatcggcgacctgcgggtaggcggcggccagctgccgcagcgccttcttcgagatgccgaatgccgtcgcatacacgaggtagcggtcccacaacgtcaggtcgagcacgccgcggtcgctgaactcactgaagtcctcgaggtatttggccagccctcgcacctgccctgcatactgctggccggaatcggtgatgccggtggtggtgcagtagacgagcgcgaacaggcacagcacggtgatcggcaggctgatgcacaatgcgagtgcaaaattatgctccgccgcaatgaagtagaacgcgcttgcaatgccgacgatgatgccgaggatgccgcaggtcaccgccgccgtgccgacggatctggtggcgtgcagcgattcgagttcggccttgcaggccgcattgaacttctcgatcgccttgtatccgttcgtccatttcctgaacgccttgttcatctgcctgaggtcgaacaccggcgagtggatgcgcttgtacgcctccatcagaatgccgagcagacgttcctccgaaccgcataggttcagctcctcatgatgctcggccagcgcgcgcggcatgatcacaatcgtgctcgtcttcatgagctccttctcgctcgccccattcgacgaaagcatctgcgcgagaccggccgagttggcgcgcgacatgtcgatgccacggtagagttcggccttgcccggatacacggcgattgcccccttgctcaccagcgacatcatggtcgacgccatctcgcggttcgcgagtgtcaccccaccattgcgcacgcccatcacgatgtcgtagagctgggccgccgccgcagggctcatattgggcggctcacgccagtattcgatgttgcccttgtatttggccgcatccacgctgcgaatggcggaacgtatgccgaagaacgcgagcagcgcacctgccaccgcaatggcaacccacagcacgatgcgcagctgtgcattccggcgttgccgctcatgccattcgcgctcctgacgggcctcgtcgtcgagcgtccactgcttcgtgtcttcgtccacatgacgtgtcacaccatgcatgtggttggcgccgatcatcgccacgaggtcgaggtactgcccggatctgacgttgtaggcggtgaacttgagcccgttggccgttcgctccgtgcttgagttgccgctgtaatggagccatgcccacgagtcgctcctcgtcacgcctgcggggaactccacggtcgtcgtcatcacgccgatcggcgtctggttcttcgcaccgaagggctcccactggaatttcgcgacgtcgttgtaggcggtcgtcacgccctcccatgtcatgtcgatctggaatcgcttgctgctggacgattgtgtggctgggatgttccaacctatctccaccgtcttcgtcaccacaccatcactgccgcttgaggcgagaccgtcggtcaatggttcatagggcttcgggttcgtgtcgccgtcggtgacatcggctatgtaccagcgtctggcgaacttctcgttccaggtggagttcgagatgccggagggcgactgcggttcggtctgcgtgtattcctcccccgaggtgaggttcttcacgctgatgttcgtgatgttggtcagattcgacgacctgagcgtgtactgctggtacagctgtttccacggcttcggattgtcatcttcgtccttgcgggagtcgagcttgacgtcgacggtctcgcggatgcgcagatcgccgttgtcttccacccgcacattgtagtcgagcgcacggtagctcagatccgaattgttggcgtcggtggccacgaagtagccgaggagcagcgtcgccacaatgatgatgcagctgatggtgaatgagctgaaaacggagcgtgagagtttcttcatcgatgtccttgcatcgcacgcgaagcgcgcagagtatacgaacgccccgcgtatacggccatgcgcatacgcggggcgcgggaactcagaacttgacttgcgggaccgagcgatcggcctcgtccgcggcgaaatactgggccggctggaagtggaacatgccggcgatgatgttcgtgggcacctgcatgatgcggttgttgtacttgagcacggtgtcgttgtagaactggcggccataggcgatcttgtcttcgaggctggcgaggcgtccctgcaggtcgaggaagttctggttcgccttgaggtccgggtatgcttcgacaatcgcccgcagattcaccatcgcgttggtgagtgcctgctcggctgcagcgcgctgctcgagcgtggaatttgggttgttcgcgacttccacgacgccggcgcgtgctttcgtcacctgttcgaacacggtcgactcatgcgtggcgtaccctttcacgacctccacgagattcggaatgagatccgcacgctgcttgagtagcacatccacctgcgcccagctgttgccaacccggttgcgcatgccgatgagactgttgtacatgccgatgacccagattgtcagcacgagaatgattgcaatcacaatcagcgcgataatccaaccgctcatatcttctccttccatgcgcccggtgcgcacgcaatggcacgattatcgcatttcaccataccctcacataatcggtgtccagctcatgagaggctttgcggatcacgcccatcagcatggctgcgaatgtccggattccccgacaccacatagatgtctgtccgtctcgacacatggatggaaggcgcccggatatgacaaagggaggatcggcattgccggatcctcccttatgcaaacacgctatctaaatcgatccagtcgattcagaacgcccggatgttcggctcagtcgtcgaacggatcgaagtcgcggcgcacacgacgacgcggacgctcgtggcgcacctcacgtccctcgcggtattcgtcgtagttctcatcggcgacatagcgcggattgcgatcatcattgcggcgacggcgcggacggtcatcgtcgtagtcacggcgacggtcggagcggcgcggacgatcatcgtaatcgcgatcgtcatcgtagtcacggtgtgagcggcgacgcggacgatcatcgtaatcacggtcatcgtcgtagtcacggcgacggcgcggacggtcgtcgtagtcacggtcacggtcgtcggaacggcggcgcggacggtcgtcacggcggcggtcgtcggaatgacggcggtcatcacggcgcggacggtcgtcggaacggcgtccaccggcattgttctcctggttctcgaagcccgggatggccagggagatcttgccgcggtcgtcgacgccctgcaccacgacctccacggaatcgccttccttgagcacgtcctcgacggcgtcgatgcgctggccatcggcgaggttgcgaatctgcgagatgtgcagcaggccatcgatgcccggcgtcaggttgacgaaggcgccgaacgacgtggtcttcaccacggtgcccttgtaggtctcgccggcctgcggcacgtgcgggttggcgatctcgtcgatgatctgcttcgccttctcggcggcctcgccaccttcggaggagatgtagacggtgccgtcgtcttcgatcgcgatctcggcgccggtgtcttcctggatctggttgatcatcttgcccttcgggccaatgacctcgccgatcttgtccaccgggacggtggtggtgatgatgcgcggtgcgaacgggctcatctcggccgggccgtcgatgcactcgttgatcacctcgagaatggtcttgcgtgcttcatgggcctgcttgagcgcaccggcaagcacgtcggccggaatgccgtcgagcttggtgtcgagctgcagggcggtgatgaagtcggcggtgccggcgaccttgaagtccatgtcgccgaaggcgtcttcggcaccgagaatgtcggtgagcgtcttgtagatgtgctggccgtccacgtcaccggagaccagacccatcgcgatgccggccaccggtgccttgagcggcacgccggctgcgagcagcgacagcgttgaggcgcacacagaacccatagaggtggaaccgttggatccgatggcctcggagacctggcggatggcgtacgggaactcctcacggctgggaagcaccggcacgatggccttctcggcgagggcgccgtggccgatttcgcggcgcttcggggagccgacgcgaccggtctcgccggtcgaatacggcggcatctcgtagttgtgcatatagcgcttggtggtcgggcccgacagggcgtcgatctgctgctccatcttgagcatgttgagcgtggtgatgcccagaatctgggtttcgccgcgctggaacagggcggagccatgcacgcggggcaccacgtcgatctcggcggagagcgtgcggatgtcacgcaggccacggccgtcgatgcggtagtcctgcgtgaggatgcgacggcgcacgatctggcgctgcagctccttgaacgcgttgccgatctccttgtctttctccatctcgtccatgtcggtgaactcgacggacagcgtgtccttgacgcgctgcttgatctcggcgatgcgctcctgacgcggcagcttctcggcgatcgacagcgcctcatctaggtcggcgtgcgcgatctcgtcgatgcggttgtacaggtcgtcagtgtactccgggaacagcgtgaactcgcgggtctccttggcggcgaggcgcttgagctcgttctgtgcatcgcacagcaccttgatgaacggcttggcggcctccagaccgccggccacgacctcttcatccggcttctgctggccttcgtcataaatgaggttccatgcgttcttgccggcaccggcctcgatcatggcgatggcgacgtcgccgctttcgaccacacgaccggccaccacgatctcgaacacggcgcgctcacgttcgctccaacgcgggaacgcgacccactggccgtcgatcagggcgagccgcacgccaccgaccgggccggtgaacggcaggccggagatgagcgtggaggcggaggccgcgttcagggcgagcacgtcgtaggaatcctccgggttcacggcgagcacggtctccacgacctgcacctcgttgcgcagcgtgtgcgggaagagcgggcgtagcggacggtcgataatgcggcaagccagaatggcctcggagctcgggcggccttcacggcggaagaacgagccggggatcttgccggccgcgtacatcttctcctccacgtccacggtgagcgggaagaagtcgtagttctccttcgggctggagccggcggtcgtggtggaaagcaccatcgaatcgtcgtcgaggtaggcggccacggcgccgtccgcctgccgggcgagccgtccggtctcgaagcgcaccgtgcgcctgccgaacgaaccattgtcaattacggcttcaacagccttgatttcgggaccctccatagggttcctcctttagttattttttctttacctacatacattcaggcgcgcaagcatccacgcacccacgggcgtatcccgcatcgccggtaccctgccggcgaacatgccgattgcgccgtcccggcgcattctcaccaacttcagattgtataccgcctcccgcgcgcccccgcgtgggttctctcacgaattaagcgatgtcgcaggcggccacgtcatcttccgcatgcgctcccagcattccacggcaatccggcaatccacgaacccatttgcggattgccgggtacgaaccgaatacaaaaaggcccgaactccggcagagctcgggcacaagactagcggcgcaggccgagacgctcgatcagggagcggtaacgctcgatgtcgaccttcttcaggtagtcgagaagacgacgacgatcgccgaccatgagcagcagaccgcgacgggagtggtgatcgtgcttgtggaacttcaggtgctcggtgagatcggcaatgcgcttggtgagcagtgcgatctggacctccggggagcccgtgtcaccctcatgggtagcgtacttagcgatgatgtcctgcttttcttcagccgtcagtgccacggcatcctccttgtaactgcgcggtgccaccgacctcatgccggagcgctctctatccgcgggcgaaacacgccaatcgaccattctacgcactggagcggacgatggacatcctcacgcacaccacagcctcaggcgaccatgatgcggcctttttgttcgcccacgacgtacgcgaccgacacaccagcttttgacgatatctgcgcttcatatactcagagtcatttaccgccccgcattcgcggaatctgtgcggggcggcgtcacacccgcgtcacagacgcatgagagaggagaagaggaaatgggaatctgcacgaagatcggcatcgtcggcatgggtcacgtcggcgcgcacgtggcgaacagcctggtgttgcagggcatcgcggacgaactgtacatgaccgagatctgctcgggcgagcgcgaccgcagcaagaaactcgccgccgaagtgcaggacctcggcgattcgctcgcattctgcccgcacaatgtggcgctgcacaactgcggcgacgactacgcgcagctcgcgcagtgcgatgtgatcgtgaactgcgccggcgacgtctcgctgtcgtccaaggaccgcgacggcgagctcttcttcaccaccgacacggcgaagacgttcatcaagacgatcgcggacgccggattccacggcatctggatcacgatcgcgaacccctgcgacgtggtggccactgaaatctggaaggaatcgggcatggatccgcggcgcatcatcggcaccggcaccgcgctcgattcgagcagactcaagtatgtgctgtcgcgcgtcaccggctacgaccagcattcgatcaccgcatacatgctcggcgagcacggcaacagccagttcgccgcatggagcaatgtgtatttcggtggcaagccgctctcccagcttgccatggagcagccggagcgcttcgccttcgactacgccgagctcgaggccgaggcgcgcaagggcggatatgtcacgtacgccggcaagcactgcaccgagttcgcggtggccgacgccgcgtgcagactcgtgcgcgcggtcatctcgaacgagcattacatcaccgcatgctccacgctgctcaccggcgaatatggcgaggagggcttcttcatctcactgccgtgcgtggtgggcgccgacggcgtggaggaggtcatgcgcctcgatctgtccgacgcggagatcgacgaattccgcaagagctgcgcacacgtgaaagagaaccttgcgcgcacgcatattctatgatccgacttcgtccgcgtcctcggttccccttggtgtcctcttggtgagacaaaccaggtacggcaaccgggtgtgctatgcgacggccatgaatccgccgcagaacagaatcgcgagcgcggccagctcgaagacgaggaacatgatgaacgagacccacacatgggtgagcacgttgagcggcgaatccttgcggatcatgacgagcagaccgacccacacgatcgcgaacacggcgagcgcgagcgccgacgcgatgacgcccagattcgccgcattcgccacataggcatgactgccgtagatcacgtacgtggagctccagaagttcagtttgaacagcgagaggccgcctatgaactgttcgagcgagaggaagacgatgaacgagccgaaccatgccatgcggcggttgtccacgatcatcatgatgagcgagacgaagatcatcgtggtcacgccccagctcaccagagcgatgccgtaggacgtgaagtggccgagctgctcgatcacgcgggcggtgctgtgcacggcgaacgagcgccccacccagaacggtgcgatgagcgcggcgagcacgagcacgattgacacggtccacttcaccgggttcgactgcttgcgttcgatgtcggccagcgagatgtcagattccggtatcgtcgcctcggggtgcttcgagacgatgttctgggccatcacgcccgcgctgctcggcgtcgtcggtgtggcggcaggctcggatcggagcctggcgatctcctgctgctcggaatccggcatgcgtgccctccccgttcgtgctgctgcatattctgccatatagcgaaaatggctggattcacatccagccatttcgagtggagcggatgacgggaatcgaacccgcgtaatcagtttggaagactgaggctctaccattgagctacatccgcgtgtgccgaggcaacgttgccattatacacaaccctccccccgcaggcaatccacggcggtcactcccgcatgtcgagcacggctaccgccgatgcgatgccgccgtcgtgcgaaatcgacacgtgccagaccggctcagcgctttccgtcactgccagcgagcggcacagctcgacatggacttccgctgccatgacgacgcgtgggcaccctgtggcgtcgtcgacgatctcgatgcgcgaccatggcgtgtcgtccaccgtgtatgggcgctcggtgattccacggccgacgagtgcctcgcaccacgccttgaccacagactccttcgccgcccacttcgccgccagatgcaacgcctcgccgtcgtgcttgatcgacgcgcgcagactcgcctgccggcactcgcgcgcggagaagagccgcgtcatacgcgtgcctggcatctcgagctgttccgcgaacgcgccgacgtcgaccacatcgtgccccagaccgagcatcatcgtcacctccaccctcgctgcgctctggctgcagattacccgaccatcttcgcgagggtctttcgtgttcgccgagacattggcgaacacactgattatccacgaatgccgcagatttcgtcctccacgcgggaatctgcgccgctatggcgaaactcatggcattgttccgtcatagtggcggatcattgcgggcagattcgcgcatgtgcggcgaaatccgcgtgaaccgtcaggcgaagtacccatcggcgccgagacgcgcgtccgggtcgagcagcatggccttctccacctcgtgcgcgtcgtagccgcggccgtcttcgtggaagcggcggttgtcgatcggctcgtagagtgccgcccggcccatcatgccctcctcgaagtggcggcggcccgctgccagacgctcgttggcgcgtgcacgccaggccttgagggcctcgacgccggcggtgtgctcgacggcggcctcgaaggcgcccgggtgcacaatggccgtgaagccgctcacgtggccgaagccgagcgatgtggccaacgccgccttcaccgtgtggcgcgaaccgatgtgcagtggctcgcgcagccacaccatgaggtcgtcacgctcgagcttagggtcgacgcattcgagcgaggcattcgccgggatcacaccgcttttgaacagttgggtgatgccgttgacctggaagatgcacgcaccgcccttcgcgtggccggtgagcgacttctgcgagatcacgaacagcggattgccgtcctcgcggcctatggcgtgggccagcgtgttgtgcagctcggactcgttggggtcgttcgcgttcgtggaggtgtcgtgcttcgacacgacggtgatgtcgtcggggtcgactccgagccgtgccaggtcacgcacgagcttcgacgagcggccacccatgccggcggccagggcgccgagaccgggtgccgggatcgaggtgtgcgcgccgtcggcgtacgaatgcacgaatccgaccacgccggcgaccggcaggcccagacgtaaggcgatgtcgccgcgggtgagcaggatcgtgccgccgccctgcgattccacgaaccctccgcggcgacggtcgttcgcccgcgagaagaagcgtggcgcaatgcctttgtcgagcatctcctgcgaattggcggtggcgttcatgttgccgaagccgatcaccgattccacgccgatgtcgtcgatcgcaccggtcaccacgaagtcggccttgccgagcgcgatcttgtctgcgccctcctcgagcgagacggccgccgtggcgcatgccgagaccggctgcaccatgttgccgtagccgccgatgtagctttgcatcacatgcgcggcgaccacgttcggcaatgcctcctgcagaatgtcggtggggatctcgtggttcaggaaccggtcgagatagagtttgcgcatgctcgacatgccgccgaagcccgtgccctgcgtggaggcgaccatcgacgggtgcacggcctcgagaatctccgctggcgtgaatcctgccgacaggtaggcgtccactgtggtgacgatgttccacagagcgatctcgtccacatcgcccaccatggaggccgggatgccccacttgagcgggtcgaagccgtcggggaactggccgcccaccgtgcgcgtcatcgcggcgcggcgcggcacgcggatcatggatccggcatggcgggtgacgttccactcgccgctctccccgtcctgagccaggctcgtgtgctcggggtccatcgccacgtattcgtcggcgatctggcgcgtcggcacaccgaaggtcacgtcgtggtcgaggtagacctcggcctcctcctcgtcggtgccgctgcggtagtccgaccccatgccggtttcgaacggccgcacgccggacttcgccacgacctcgtcatggtagcgttccgcgatgtcggtttcggggaccagattgccgtcggtgtcgtaccagcccggcttcggcgaatcctgccagctgagcaggcccatgttccatgccagttcgagcaccgcgcccgccgagaggtcgacctcgccgtccgcatggatgccgagctcggcttctgcacgggtgcgaccggatccccatgggcccagttcgccgatcgagacgatgacgatctcgtcctccggcttcgcgcttacgcgctcccattcggcgaggtcgacggcggcctgatgcggcacgcgggggctcggcaatgccttgatcggcgcgtccgcttcggtttccgacgtctcctccgccgcgtcaggagccgcatcggcgagggcctgcgcacgcagggccttgatgtcgatcggctcggagccaaggccgccggtcaggtcgacgtcgagcggcgccacctgcgcctgctcacgcgcggccgccgtggtgagcttgagcagttcctcggcgatctgttcggtggaataggttttcagaccgtgccgctccacaacttcgacgagcgggtcgttgccgcccatgagaccggtgccgcgcacccagccgatcttcggatgggcgaaggtgacgcgattcgaccacacctgttcgctgcgcgcacggttgacgatggcgtcgaaggcgctcttcacctcgccgtacgcgccgtcgccgccgaacacgccacggttcggcgaacccgggagcaccacatggagcttgtgctgcacgtcggtgtcggcgccgatcgccgcgaatccggcgatcgcacgttccacgccccacagcatcaggcgcgcctgcgattcgaacaatgcacccgaatcggccagcgaaccgtgcaccggcggcgcggcgaacgggaagaacaggctcggctcgtatgcgggcttgagcaccgtggtggtggcaccgctcgtcttcttctgcacgtggcccacccagttcacgagcgcatccacatcgcggtagctcgacagattcgccggcacgagccacagcttggcatcgccctgtgcatgctcgcggtaggtgcgctgcgcccacgccttgacgctcggcttgaagctgtgcgaggtcgcgattaccgtggcgccctctgcgagcagaccgttcaccacctgtgccgcgatcgagttcggggcgacgccggtgaccaccgccacttcgccgtcatattcaaggtgtgcagattgcgtggattccatggcctgctgtgcgatacgctcgtactgctcggcaagcgcgctgcccgcggactgctgggcataccatgccgcctgccgggccactgccgcgcccgcaccggtgaaatcgccggcgatcgcgtcggtttccccgttgtagtaggcgcgtgcgaggtcctcacgggcggaggcccaacggtcgtcgaagagaatggcctggcgctcgtcgaagcgcggggccacctgtgccggccagtcggagccgagttcggcctccaccgtggccacgatggcggcattctcgtcttccgcctccaccgcgttcggttcggcgagaccgagctggcccagcacgaaacgcgcggtggcggcgagcacaccgtcggaaccggtgacggactgcgcgtaggcgtcgagggcagccgaatcgaccacgccaccggacgcgccaccggcgctcggcatggccacctgcacgctgtgtgccgcggccacggcctgcacggccgcatcgatcaatgcgttcgcagccgccgcattggacgccgcatcggtgcccagcgtggcgaggtcgccgccacgggagctggtgccctcacgggtggcgagcacgagctggcccaccacatggttggcccagccttcgccgagctgccaggtctcggtcacgcgcttggtgatctgcggcagcttgacgccggcggcaccgaagagactgcgtacgcggtcacgtacgatgtcggaaagcaccgggccgaatgccttgtaattcggcgcaaccttgtctaccaacgcattgaggtcgcgaatgctcgcctcggcggcgccgtccacactggccacgccgagctcggagctgatgtccatgagcagctggttgcgacgcgaggagacgccattggtgagcgtgtcggtcgtgtcgttctcgccgatctgctccggacgcaccttggcggcgtaggagagcagcatctcgatggcgtcatgggcacggtagtcgaggtccggcacattggcgccggaaacaccgcccgcaggtgccacgggtgccacgggctcggcggtttccacgacgacgctcgcggaggcgttcgctgcggcgacggcctgcgcaggggcggccgggtcggccgcaggggtccgcacatcgtcgacctcgggcacgagcgagtcggaatcggtcatatacacgcgtccttcgtcgcggcccacgttgtacacggtcacatggcggcgggagaactccggcagacgcaacgtcttcgaggcaagattcgcaagcgtgggcgcattgcccagacccacttcgacaatctcctcgacgcccaagcctccctgttcggccgaaccgaacagcagcgcctgcgtttcgatccagcgcaccggcgaggcgaactgccaggagagcagctcggtgagcagcagacggccgagcttctggtcgtcggcggcataggaatcccacacggcgtcgtcggccaatgcggcggcgatgcgctcgctgggcaccacgtcgagaatcttctgcgcgaactccttcgtcatctcgaacggcgcggccacgagattcggaatgtagagcccttcgagcgcgccacggtagtcgatctcggcgggaagcagcgcgtcgagcttgtcgcggaactcgggcacacccttgcgcagcagcgtcgaatggaacggcacatcgatgccgggcacgagaatgaacgccggcttgccgccatattcggccacgcgccgagcggaatccgcctggagcgccttgaggcctgcgatcgtgccggcaatggcgtactgctggccggcgagattgtagttgacgatctcgaggaactcgccgctcgccttggccaccgactccacgtattccttcacatgcgcgtcgtccacgccgaactggttgggcctgagggcgcccatgcggtagttcgaacggccctgcgcgtcacggtcgatcaggtggtgcatggtggagccgcggtggaacacgagttcgagcacggtctccagcgggatcacatgggcgaaggagctcagcgcgttgtattcgccgagtgaatggccggcgaagtacgacgggcgaatgtctgcccccgcctcctgcatgcgtgcggtctgcgcgaacgcaacagtggcgagcgcgacctgtgtgaactgggtgagattgagcaggccctccgggtgacggtaggtgacgccgttggcggtgagttccttcggattgtcacgcacgacggcgagaatcgagaacccgaggcgctcgcgggtgagcctgtccgcgcgctcccatacgtcgcgggcggccggcgacttggcacgctcgtcaagcaccatgccctgctgctgaatgccctgaccgggatatacgaacgcgctgatcggcgcacgggcgatcgccgtggcacgcgagacgatgctgccgtcgatgcggcaggtcacctcgagcacgaggccggcgtgcgccacacggccgatgcgttcgatggagatctccacctcgtcgtcgagctgcaccatgccgtacatgttgtaggtccagcctgcgatctcgtagtgcgcaccctgctcgtcgagcgcctgcacggcgtgctgggcggtggcggagagccacatgccgtgcacgagcggctgcgtcaggccgctgatcgccgcgccacggtgcgaggtgtggatcgggttgaaatcacccgaagtgcgggcgaacgcggtcatctcatggggtgccctgacgttcacgcgacgcagcatgcggcgtggcgtggagacaatctgctcatcgatgccgccgaagtcgggtgccgcggccggcagggcgtcgttgtaggcacggccgcgaatggcgaatcgttcggtttcgttggccaacacggtgccgtcggcggccgtatgccgcacatggatggtgacgacgcgtccgctggcggattcgaagtagggttcggcccagcccgtcagcgagatttcctcgccggtatgtgcgaggagctcgtcctcgctcacctcgagctcgatgagatggtcgagatggacggcgttgagcaggccctcgatcaccgggtacccgtccaccatgacggagccgagcgccgcatagatggccggccatgccggtcccacgagtgcgtcgggcgcgatgcgggacggcgtgagatccattggcagtgcgccaccggtggccgcctcgtggtcgaagccgaggttggcggagagcgtgtagcccgcatgcgcctggccgaacgggaaggtctcggtgtcggccacctcggtgatctgcggcatcgcctcgagtttgtcgccggtgatggcggtgttgccgatgccggcggtgtcggcgagcatgcggtacacgtgttcgggcaggcgttcacggtcgaccaccgggatcatgccggtggcgtcgagcgtcacgttgagcggaatgacgatgtcgcgcacggcgtgcttggaaaggccgccgtccgggtcgtcgtcccagaacgtgtcgaggtggatgtcgaggtcgaactgttccacgccggcctgctcgtcgcggccgaggtgcttcagttcgtagttcgcgtcgccgcgggcggtgccgaaggccgggttggccatctggtggccgatccacgagatgttcgggctgcggcgaatgaagtcctcggcgtcctcgcagtcggcaagcaatgcgaagcgatcggtccgggaagccgcgttggacgccacgcgcgcggtcatcgcatcgctgaagcggcccagaatgtcggcgacgggctcgtccacggtggtgatgccggccaccgagatcgggccggggatgatgcgcacggagtctgcggaatagcgcggatcctcgctctgccacagctggtcctgcccccaccagcgcaacaggtcgttgtcgatggccggcacgaacggcattggcttggggtattcgcgtacgagttcgatgaaccacgcctcgtcggtgggcaccaccttgagttcgcccatctgcgggtaggcctccaccaatgcggcgagtgcggcgaacggatcggactccacgtcggcgcgcgtggagaacatcggcgtgaactcgccctgttcgaggtcaatcacacgtgcttcgatgcgctgcagcaggtgcaggtagcggtccgcatacgtgccgtcggcccacgggaacgagagttcggcgaaccgacgtgcccaatcctcgtaggtcatgccgctcaggtcgccgaaatagggcttggcggtctcgttcagggcgtcgatgatctcctggcggcggctttcgagctcctccgggtgcttcatcacgcgcacgagcaggcggccgcagcgggccgatgcgttctcgagttcgtaaatgtcggcgtgcaaatggctcaggccgctggaaacgccgcccacggccttgccgctcggcacccaggcctcgccgagcggggcaaacacgtcggctgcggcgtcggaaccggcgtcggcaatacccggcgtcgcgacgagcagctgcttgacctccggcgacgtgtgcgcctccttggcggtcatgaccgcggtgccgacgagcacgccgtccaccggcatgagcggatggtcgtaacgtgtggaccattcgcccgagatatagtcggcggcgcgttccggggtgccgatgccgccgccgacgacgagcacgagattgctctgctcgcgcacttgggcatacgtgttgagcagcaggtcgtcaagcgactcccagctgtggtggcccccggcggagccgccttcgacctgcacgagaatgttcgcgggcgcaaccgccttggcgatgcgcaccacctggcgaatctggtccacggtgcccggcttgaagcacacatacgggaacccctcggcgttgagctccttcaccagagccaccgcctcgtcgggctcggggatgccggcggagatgaccacgccgtcgatcggggcgcccgaggcacgcttcttcggcacgatgcgggaggtgccgaactgcagattccacaggtagcggtccatgaacatcgcattgaattccacggtgcggccttcgtcgagctgctcctcgagctcggccacatggcggtcgaacacgtcggcggtcacctggccgccgcccgcgagctcggcccagtagccggcattggccgccgcggccacgatctcggggtccacggtggtgggcgtcatgccggcgagcagcaccggcggcttgccggtcaggcgggtgaacgcggtctcgatgcgctcgccctgcagggtccgcaccacctgcggaacgtactgcgtccaatcctgcatgcgggcgggggcgtcggtctccgtggcaagcttggcgcggtcggcaacgttcgccgcctccacaacacccacgccggtgccttcggccactgtgccgaacagcttggcgagcgtggtgccgggaccgagatccacggcccacaacgtgcgcggatcgttctccttgaacagattcgccacctgcgcgctccaatccacctgattgacgagcacctcgccggcgagcacacgggcacgggccacgtcgatgccgcattcctcggcccaggccaccgtctgctcgacggcctgttccatgatcgggctgtggaacggcagcgtcacctcgaggtattcgagcaccgggtcgaacacgctgccgccacgcaccttctcggcgcgcagctgcgcctggtgcttgtgctccttggccacttcgacggcgaaggaggcgaggtcctgcgggtggccggagagcacgacgtggttcgcggaattgatcacggccacggcgatcggcccgcgggcgtcgtccacgcggcgaatgagctcgtcggcctgggccggcagaatgcccttcaccgagagcatcggcgtggcgtcaccgtacttgcgcaccaagccgtgggcgcgggcctcgcgggtgcctgccgcgccgatgagtgcggcgatggcgagaatctcgtcgatctgcgggcgtgcggcttcgatcgagccggcgtcgatgatggcctgcgccatatgcacgccgagaatgccctgcgaatggccgagcaaggccaccggattcgcactggccagcgtgtagccgagctggtcgaggtcgagcagggcgccgagctgtgcgagcgcgatgccttcgatgctggcggtggcatcggctgcggggccgagcttggccgggttcgcttcgaaggagaacagatcggtctcacggccggtcgtcgccagcaattgcgccgaaaccggggtgagcaggtcgtgggcggcagccacgtggtcgatgagccgctgtgccagctctggatcgtccatgagctgcttgacggccacgacccatggcgtggactggccggcgaacataagggcgtgtggctccgaattgagtcggttcacaaagaattccggggtgctcatactgctgtctctcatttcttgtgtgggtatgaattacggatgggttctgcggatgtggattgtggataacttttcccgcgcgtcaacaaatgcacacggtctggtgtggataacccggcatgctgggcccgacctagagcggctggttgccgtgatgcttgccggtgcggctcacgcggcgtttggaggcgagcgtcttcagggagtccacgagcacctcgcgggtctgctcgggatcgatcatcgcgtccacctggccgatctccatcgacagattcgcgttcaccgtcgtctcctcgtactcggcgatgtacttcgcgcgcaccgcttcgacgtcacgaccggcgtccttggctttctgcaggtccttgcgatggatgatgttcacggcacccgccgcgccgagcacggcgatctggctggtgggccacgcgtagttgaggtccgcgccaatcgccttggatcccatcacgatgtaggcgccgccgtaggccttgcgcatgatcacggtgacgagcggcacctgcgcgttcgcatacgcgtagatcaccttcgcgccgcggcggatgatgccggcgtgctcctgctcggcgcccggtttgtacccgggcgtgtcgaccagggtgatgatgggcagattgaacgcgtcgcacagacgcacgaagcgcgccaccttctccgatgaatcgacgtccagcgcgccggcgttcacgttcggctggttcgcgacgatgcccaccggctggccgtccatgcaggcgaaaccgacgacggcggattgcgcgaacagctcatgcacctgcacgaactcgccgtagtcgacgaggcagcggatcacgtcgagcacgtcgtagggctggcgttcgttcccgggcaccacggtgccgagccgttcggcgatgtcgcggtccgcgcgcgtggccatataggcgtagcgcggggccgtctgcccgctgttggccggcagataggcgagcaccgtgcgcgcgtagtcgattgcatccgcctcgtcggcgcccagatagtgcgcgacgccagatttcacgttgtgcacgatgccgccaccgagatcgtccatgctgatcgactcgccggtggaggccttgatcacgtcgggcccggtgacgaacatattcgagttctcccgggtcatgatgatcaggtcggtcagcgccgggcaatacacggcgccgccggcgcacggtccgagaatcaatgagagctgcggcacgaatccgctggcctcgcaggtcttgcggaagatgttgccgtattcggtgagcgccgcgacaccctcctgaatgcgcgcgccgccggagtcgatgagcgcgatgatcggcacgcgcagcgcgagcgcctgatccatcagatggcagatcttgcgaccttccgcaacgcccagggaaccaccacgcaccgagaagtcctgtgcgtagacggccaccttgcgcccccagacctcgccgaatccggtgatcacggcggaaccggcgacgcccttgttgatgtcaccgccgcggaaccgcccgatctcctcgaaggttccggagtcgagcagcaggtcgaggcgttcacgcgccgtgaacttgcctttcacatgctggcggtcgcgcgccctgttctctgcgtcccgcgcgagttccgcggccttggtcaccgcgggtcggatcggctggcgcatggccccctgcgcgtccgcgccattggctgcggcggcatcggcggcttcgaccgcggcgagattggcatcgatgctgtcgatcatgtcacgcctcctcggtggtgtcggtggtgggattggctggtttcgacgttccggcgacctccatggtcagcagtgtttcgccggcctccacgccggtggctggcgaggcgaagatctccttcaccgttccgttcgcgggcgaatacacgtagttctccatcttcatggattcgagcaccacgagcaggtcgcccttcgccacctgctggccttcgctcacgttgatgcgcgtgaccagggcctgcattggcgcggagatgacgcccgggcgttccgcggtgcgcgcgttgccgcggtccacatggtgcgagccctggccccgcaatggctgcgtgggcctgcgttcgccgtgcgagcgggccgcgccggtgagattggcgaacatatcgctcggcacattgagcaccacgcgccgattgttcatttcgatcacgaattgctcgctatggtcgagttcgggttccgccgcccctgcgccggcatcgagcgaagccggctggccgccgtgcacggtggccggttcatggttcaggtatttgcgctcgagccatttcgtgctcacgtcgaaaccatggccgtgctcggcggtgaactcgtcgtcgccgaacacctgccggtacagttcgacgggcgtgggcacgccttcgatgcgcagctcgtcgagtgcgcgcctcacacgggccacggcggcctggcggctatgtgcggtcacgatgagcttgcccatcatcgagtcgaacttcggcgagatcgtgtctccttcgactacgccggaatccacccgcacgccgggtcccgctggccactgcacgcgttcgagcgtgccggagctgggggtcaggttcgtcttcgggtcctcgctggtgatgcgcagttcgaaactgtggccgcgcgcggtcggttccggtgagaccttgccgccggcggcaatctgcaattgttcgcgaaccaaatcgagtccgctcacctcctcgctcaccgtatgctcgacctgcaggcgcgggttcacctccaggaagtacaccttgcccgcatcggtcaccatgaactcgcaggtgcccaggcccacatagtccactgcgtcgaacagccggtgcgaataggcatgcagctgctcgaccacgtcgtcgcccaggaacggggccggcgcctcctcgatgagcttctggttgcggcgctgcaccgaacagtcgcgcgtcgagtacacggtgaagttgccgtgcgaatcgcggccgcattgggtctccacatgcctgccatggtcgatgaaacgctccacgaagtactcgtcgaggtcgccgccctgcacggcgttgtggttcaggtagaagccgcgcagctcgtcgtcgtcgcgcacgagcgtgatgccccgtccgccgccgccgtccgcgcgcttgagcatgagcgggtagccgtgcgtgtgtgcgaagtcgagcagcacgcgcatgtcgccgagcgaatgcgagatgcccggcaccggcggcaccttggcgtacacggccacgcggcgtgcgctgatcttgtctcccagatcggtgagcgcgcgcgacgacgggccgacccatgtggcgccggcctcaatcaccttgtcggcgaaactcggcacttcggagaggaatccgtagcccgggtgcaccgcgtcggcgccggaacgccggagaatgtctatgaggaggtcttcgttgaggtaggtgtcggcgtaggtgtcacccgagagcaggaatgcctcgtccgccatcttgacatattgcgaatggcggtcctgctcggcgtacacgaccacggtggggatgcccatttcacgcgcggtgcgcaccacacgcagggcgatctcgccgcggttgacgatgagtagtttggagacagtatcggtcatggtgcataactttgctctcttttgaatattcgcgaaacgtcgctttgaacaaatctgaccgctcgtttttggtgacctctacaaaatgcacacctgtgtttgcgtctaggattacgagcagcacccgggagcatgcccgcaaagccttatgattccgcctattttggcaggtattgcgcaggctgggcaatctcactgcccgttgccgaaccgtaacgttcccgttgcacactcacaatttccatgcgccacactggacacatgccggtcacgcacagagacggaaggaatacttatgcacgaacttatgcatagcgtcacccgtgtcaatctcaggtcgctcgtccgcaccctcgccccgtcgctcatcgtggcgctgctgctgtgcggctcgacgatggcgggcaagatcccggtccccggcacgcccgtgccgatcaccctgcagaccttcgtgctcatgaccgccgcgctcaccttgggttggcgtcgcgccaccgcgggcaccgtcctgtacctggggctgggtgccgccggccttcccgtgttctcgggcggcggctccacgctgtctctcatcggcccctcgggcggattcctcttcggattcgtgccgtcggtgatgctcaccgccgtgcttgcgggcaccgccaaccgcgcaatcacctcgttgcgcaccaagcacgatatgcacccggcacttgccggcgcagcccgcttcatcgcatgcttcatggcctgcgcattcgggttcctcattgccggctacggcttcggcgccgccttccagtccaccgtcaccggcatgcctctgggcatcaccgccgcctccacgctcgtcttcgtgcccggcgacctaatcaagatcgccgtcgcctcactgctggcactgccggtactcgcctctgcggattccgcacgctgactcgcgcgctataccgcgtcgtcagtcttccactggcagcacgcccacgtcgccggtgcgcaccacatgcacttggccgctgtcgtcgcgcacgctcagcgaggcgtcttcgttgattgcgaccgcctcgcccgtcagcgtcgtgccatccgtgcggtgcacgagcaccggcttgcctagtgtccagcattcctcagcgatgcgcctgtgcagattctgcgcgtaaccggccgggttctcgccgaagtaccacaaccgtttcgacagggcgttgacgagtccggcggcgatcatatcggccaactgatcggcaggcacgcaggccgcgccgttgacgcacgaggcgatcagctgcaacgacgtcgactgcgcggtgggcagctggtcgggggcgagatcgaggttgagcccgacgccgaagatgatcgccacactgttctcgtcaccgggaatctgcaccagctgcgcgagtatgccgccgagcttcatgccttggtagacgatgtcgttgggccatttgagctggagttcgctgcgcatggaggggttgcccctggtgtggtcgagccaatccatattcgccgacatcacggtctcgcgaagggcgtcgatcaccgacatgccggcgatcatctgcagccagccatttacctgcgggtcctttgcggtatcggcgttcacgatgcagatcacggaagcgatgaacgatttgcctggcaccgagacccaggtgtggtcgagtctgcccctgccctgcgtctgctcgcgcgccagtacaatggtcatgccattgcggtcgagtctgccgtcagcgacgagctgtgcggcatagtcattggtcgaggtcacggtatccagcgaaatcacatgcgccttctcacgggcgcgccggtagtcgccgttcagttcagtcgtcatacttcgattattgatgcggatatgtacgccgggtgcattcctctgtgagcacagcgctcaacgcacgccggcctcgcgcatgcggcccagcgcaatcgccgtgttgagcacgaatgcgtcgcgcggattcgtggcatcccaacccgtggtctccgccgccttcttcagacggtagcgcacggtgttcgggtgcacgttgagttccttcgcggtggcctcaagcgagccaccgtgccgcaggaacgtggagacggtgatgtacgaggggtcgtcttcgttgtcgccatgcaacaccaggtagacgttgcggtagagctcctcgcgcgctacctcgtcgccgagcagtgcgcgctcgggcagcagttcgtcggcgcgcagcggccgcgactgcgtgctcagcgacggcgcggcctgcagcgagaacagtgtttcacgcaccgcgtgcgaagctcccggcacgccttcccggaccgggctcaaatacacggcctcggattgcgcgaaggcaggcaacgctgccgtgcagactatctccgggctcaccgccgcctccagctcgatgcaggcgatcacgaaccgcccgtacataccaaagatcgcatgcgagccgccgaaatcgcgcaccgccgagctgatctgcgtgaatgtggcgcccatggaatccgccggcgttcccccgagcgcgaagcaactgaacgaaccccgccagccgatcagattcatcagcgagaccacgcggtcgtcgtcgatcccgctgatcaggcattcgaacacgagtcgcatcacggcattgtcgtcgatgtcaccgccgagcaaatcgagaatgtccgcatgttcgaatttggtcatggttccagtgtacgattcacgccctaaatagtgggctcaatagcaagcaccccgtgcagaatctgcacggggtgtctggacggcgaacggattggcgttgcgccgtagagcgctgatctggatcagatcgaggccggatcgaccgggatgcccgggttcatcgtggaggagatcgtcgccttggtgatgtagcgacccttcacggtggccggcttgaggcgcttgacctcgtctgccacggcgcggaagttctggtcgagggcttcggcggagaacgagagcttgccgaagaggaagctcaggttgccgttcttgtcgacgcggaagtcgaccttgccgcccttgatgtccttgatcgccttggtgacgtccatggtcacggtgccggtcttcgggttcggcatgaggccacgcggaccgagcacacggccgaggcggccgaccttgcccatcatgtccggggtggcgaccacggaatcgaagtcgaggaagccgttggcgaccttctcgacgagatcgtcgtcaccgacgatgtcggcgccggcctcgagggcctcggtggccttcgggccacgtgcgaacacgaggaccttagcagtcttaccggtgccgttcggcaggttgacggagccacgcacgagctggtcggccttgcgcgggtcgacgttcagacgcagcacggcttcgacggtctggtcgaagttataggccggcatgctcttgagcagggcgatggcctcttctggcgtgtacaggttgttgcggtcaatgcgctcggccgcttcacgatacttcttggagtgcttagccatttgtctctatcctctcagctcagtcgttcaccgtgatgcccatcgagcgcgcagagccctcgatgatcttcattgcggcatcgatgtcacgagcggacagatcggccatcttggtttcggcgatctccttgacctgggccttggtgaccgagccgaccttgtcggtcagcgggttggaggcacccttggcgacgccggcggccttcttcagcagatccgaagccggcggggtcttgagcacgaagtcgaaggaacgatcttcgtacacggtgatctcgactgggatgacctgacccatcttgtcctgcgtggcagcgttgtacgccttgcagaagtccatgatgttcacgccatgggaacccaggaccgggccgagcttctggccaggattggccttgccagcctcgatctggagcttgatcagcgccgagactttcttctttggagccatgttatggttcttctttctatgacgcggtagtggcggcggccgtatggcacgccttccgcaatcgatatttcctgtgtatgcgaagtcgcactccacacacaaccccacaattatgccacctattccggacgactcccgcatacgccacgggctgcctgaataacagaacgcatcccgcgtatgggacgcgggatgcgttcggcaaatgagtgtgcgtgagtgtgcggcggcggagcagggctcaggcgtcgagccgctgcacctgatcgaagccgagctcgaccggcgtatcgcggccgaagatcgacacgagcacagtgagcttctgcgtggccggctccacatcggaaacgacggccgacatcgacgtgaatgggccatcggtgacggtaacctgatcgcctaccttgtaggagacctcgagcgtgcgcttcttggcggcagccggcttgtcaccggcctccttgagcgcatgcgaggcgatcatcggggccatcatcgagacgacctccttgcggctgagcggagccggctcacgggacggtccgacgaagccggtcacgccttcggtctcgcgcacgatgcggcgggcgttctcatcggggtacatgcgaatgagcacgtagccgggcacacgcacgcgggtgacgaccttcttgcccttctcggtgtgcttctccacttcctccatgggcacctcgacctggaagatcgtgtcttccaaaccgaagctctgcacgcgggattcgatgttgctcttcacgcgcttctcatacccggagtaggtgtgcagcacgtaccacttgccttcgagcgtgcgcagcgacttggagaattccttcacggccttgcttccggcgtcttcctccgcctcttcctcggcttcggccgcggcctcgggagcttcgtcggcggctgcttcctcggcatcggcatgctgggtgtcctcgtcggcggtgccttcggaatgggcgtcggaatcgactgcggcggagtcgtccaccgaatcggtgagcgaatcctcctgcgcggccgcctggtccgacggctgcgcgtcgtcgccggcgctcacggcatcgtaggccatgccttcggcgatgtcctcgctctcggaagcggcctcgacctggtcaatctgcacttcctgcgcgtcggcggtgttgtcgtcggccgagacggcgtccaaattgatcggcagatcgtcaatgttttccaagttcacttcgtcagtcatgcggcttcactttcgtggggattcttacgtgttccttgagaacacggtactttccagtgtctactaacggcaataccgttagcaattcttcattgctaacggtattgtaggcgatttgcgggatatcggctcagccgaagatgaggaatgagagcttgccgagtccgaagtccattgcggtgacgaacaccatgagcaatgcgacgaagatgaacacggcgagcgaccagtagaacagctgcttgcgggtcggggtgaccaccttgcgcagttcgtcgataatctgcttgatgaacaggccaatgcgcatgaacacattcggcttgatgacttcctcaccgtgatcggtcttgcgtgccatacaccctccattggcttcatatgaacttactcgggttcctttgcagggaaggcgggactcgaacccacaacctacggttttggagaccgttgcgctaccaattgcgccacttccctaagtgtttccatcagctcgtcgccgagccggtgaaaccgccaagaggaaatagtagcggattgctccgacgaagtccactcgcgcgtgccgcctttgccgtttgcacacattttaggctgcatgcaaacggctccggccacgtcgctcaggcctcggcccactccttgaatcggcgcatgccctcggtaatctcctcgtcggccaccgcgtaggagaagcgcatgtaaccgggggcgccgaacgcctcgccgggaacggccgccacatggccctcctcgagcaatgcctcggcaagctcggcggaggtggtgaacgtcgtgccgttcggacccatcggtcggttcagcagcccctcgacgttcgggaacgcgtagaacgcgccctccggcatcgggcaatgcacgccgttgatgtcgttgagcgcggcgactatggccagccggcgcacattgaacgcatcgcgcatcatggccacggcgtcgagcgggccgctcacggcctcgatggcggcacgctgggcgatgttgttcacattggaggtcatatgcccctgcagcttggacgcggccttggccacggcgagcggggcgaccatccaaccgacacgccaacccggcatcgcgtaggtcttggccacgccgtcgagcacgatcagctgttcgcgaatctgcggcacggcggcgccgatgtgcgtggtcttcacgccgtcataggtgaggtgctcgtaaatctcgtcgctgatcacccagatgttgtggtcgagtgcccattcggcgatgtcgcgaatcgtccgctcgctccacacggcaccggtcgggttattcgggctcgtcacaatgatcgccttcgtgcgatcggtgcgcgccgcttcgatatcatccagattcggctcgtagttcacgtcggcaccggcgaacacctccaccggcttgcctccggcgagcttgaccatctccgggtagctcgtccaatacggcgacggaataatcacctcgtcgccatcgttgacgatgagctggaacgcctcgtacacggcctgcttgccgccgttggtcaccaccacctgttccggctccacctcgtagccggaatcacgcagcgtcttgctggcaatggcctggcgcagttccggcagacccggtgtgggcgagtacttgtagttcgccgggttcaccacagccgccgccgcagcctccacaatcgcctcgggggtggcgaagttcggttcgccaacaccgaagccgatgatgtcaatgccctgcgccttcatggccttggccttcatgtcgacggccagagtggcgctcggcgcgaccttgtcgatgcggttggaaagtgggagtctcgtctgatctgtaggcatggctccatgctactgccaaacactaacaacatgcccccggtgcaagaccgatgcgccggcatatgagacggccgcaatggccggaatctgcccgcgaggcaccaggccggcaatcacacgagcacgagattgtcgcggtgcacgagcgggtgcgcatattcctcgccaagcaggcggcgcagctgtgcggtgttgcgtccgagcatattcggaatctcctcggaatcgtaaccggcaaggccgcgcgccagatgattgcccgcctcgtcgtcgatccacaccgggtcgccggcggcgaaatcaccacgcgattcgagcacacccgcagcaagcagactcgcccgtccgccgcgcaccgccttggccgcgccggaatcggccacgagcactccacgcggatgggccgcgaatttgatccacaacctgcgcgccgaaccgcgttgcttcaccggagcgaatgccgtgcccacctcatcgcccatgagtgccggaccggcgttgcgggcggcggtgagcacggccggaatgccggagacggcggccatgcgcgcggcctcgagcttcgtgaccataccgccggtgcccacgcccgactctgaaccgcccacacgcacctgatcgagcagttcggtgatgttcggcacgaagccgattctatgggagcccggttcgcttgggggtgcggtgtagagcgcgtcgacatcggtgagcagaatcagcgcgtcggcacgcaccatgttcgcgatgagcgcggaaagccggtcgttgtcgccgaaacggatctcgttgctggcaagcgcatcgttctcgttgactatcggcaccacaccgagttcgagcagcttggccatggtgcgccgcgcattgcggtactgccgtggctgcatcgtgtcttcggcggtgatgagcagctggcccacgcgaatgccgtagcggccgaacgccatctcgtactgggccatgagcagcccctgccccaccgacgcggtcgcctgctgtgtggccacatcggtggggcgcgattcgaagccgagcggaccgaaacccgcggcgatggcgccggacgagacgagcacgatgttgccgccgagcatgcgcacctgcgcgatcgcgcccaccagcgcattgagcttgtctacgtccaagtgcccggacggctgcgtgagcgagctcgaccccaccttcaccaccacggttcgcgcggctgccaccgcccggcgtacttcctcctgggacggggtctgcatagctccactcactgttcttctcggtccttctcgctgctgtttcctctaccgtgccggatctcagtccagctgacgcgacccgtcagcgccgggctcatcctcgtattcctccacctcgccacggccgaacaacgactgctcatcgtgcctgtcgtcgtcgatcgacggatccgcccaatgccctgcggcgcgctcggcctgcatggcggcgcgcacggcggcgcgagcatccatcatctcatggtattcgcggcggcgctcggagttggtgcggcggcgtttgcgaccgtcctcctcctccaaacgcaggtccttgccacgggagccgagctgggtgccgtcgagcatctcggctccggcggcaatcgtcggatcccagtcgaaggcgacggcacgctccccgcgaccgatgcgcacctcgtcgccggcatgggcgccgtgcttgcgcagcgagtcctccacaccgagcttggcgagacggtcggccaggtaccccacggcctcgtcgttgtcgaagttcgtctgcctcacccagcgttcgggtttcacgccggtcacggtgaaccagaagttgccatggccatcgtcttcgcgttcgatctcgaattcgcgcacctgcgcattgcgcccattgcggcgctgcgtgcccggttcctcgagcggcttgatcaccacgcgctcctcgtcgacgctctcctcgcgctcggcaatctgcgcgcgcatctccttcacgagcttggccaacgcgaagttgagctccttcaaaccggcatgcgaggccgtggagatctcatagaccggcagatcgagcttctcgaattccggccgcacgaaatcggcgagctccttggcgtcgggcacgtcgatcttgttgaggatgatcacgcgcgggcgttcgggaatcggaatcgcgccgagcggcagatcgaggtcgtccgcgtattcgccgagctccttttcgagcgcgtagtagtccgagagcgggtcgcgatccggatcgatcgtcacgcagtcgatcacatgcgcaatgatctcggtgcgttcgatatgccgcagaaacgtcagtcccaggcccttgccctgcgaggctcccggaatgagcccgggaacgtcggcgatggtgtagcgcatgtcgccggcctgcacgacgcccagattcggcacgagcgtggtgaacgggtagtccgcgatcttcggcttggccgcgctcatcgcagcgatcagagacgacttgcccgccgagggaaagcccacgagcgcgacgtctgcgatcgacttgagctcgagaatgatgtcgcgttcgtcgcccggttcgccgagcagcgcaaacccgggtgcacggcgtgtcctgttcgccagcgccgcgttgcccaggccgcccgcgccacccgccgccgcgacgtacgtgtcaccggcatgacgcagatcggcaagcaccgcacccggcttcttggggaaaccctgcgcgccgcgcgcctcgaacaccacagtgcccacgggaaccggcagcacgagatccgcaccattcgagccgtctttcgtgtcccccagacccatggtgccggaatccgccgtgcgatgcggcatgaagcggaagtcgagcagcgacgtggcattctgatcggctttgaggatcaccgaaccacccttgccgccattgccgccgttcggccccgccaacggcttgtatttctcgcggcggatgccggccgacccattgccgccgtcgccgcctttcacatgtacggtcactctatccacaaaatcactcataacgcctcattctatcggtgtgtttctattgctgcactgttctacagattccggcgccgaaccatttccataccgcgtgcccgttctgcagattcccgcgtgcgcattcgacgacctcgccgaaaacacgaaagcccccgccacaacgggcggaggctttcaaagtgtgctgtacgcgaatgcgtcactcggtgacgacgtcgacgaccttgcggtcacgacgcacgccgaactgcacgttgccgtcagccagagcgaacagcgtgtggtccttgccgacgcccacgttcttgccggcgtggaacttggtgccgcgctggcgaacaatgatgttgccggcgacaaccgcttcgccgccgaacttcttcacgccgaggtattgaggattcgaatcgcgaccgttacgcgagctggacgcgcccttcttatgtgccattgttgttcctttcggtacctgtacctgctgtcagcttgctcaggcgatcgctgtgatcttgagctgggtcagcttctggcgatggcccttgcggcgggcaacgccggtcttgttcttgaacttctggatgcggatcttcggacccttggcgtcgtcgttcacgacttcggccttgacggagatctttgccagatcggcagcggcgatgatgaccttttcgccgtcgaccacgagcgcaaccgggaactccacggtttcgccattctttgcgtcgagacggttcacgaggatggtgtcgccaacctcgaccttttcctgatggccaccggccttcacaattgcgtacatatccgttcctttattcacttggaaagcttactgcccagcacgcacgagctcacggccagacaccatcaatcaactatacacacccccgcgaacaacgcaaccttcaacacgcagattccacggggcaagagaagaccggggcatggaaggtggaaacagccccggtcgatataaggagaggagtcgggtctcaacactaatagaacctactagtagaacctgctagaatcgggaatcaaccaccgtgcctatcatacgcgcgcttccgaccgaacgccaagacgcgtgtccatatgcacaatatttcgaaatctgttgagaacattgacctcaaagaggctttgcagcgtattcgaaactgaattactacgaacatattacgaaatctgcgaatttctggacgccacaagacatgctatgtacaggaaaacgccacatcgccgttgatgcgggcattttctctgctcgtcattctaccggctcgctgggcaccgacatctgtgccggcatgagtttcacattcccgcacaacccgtctacagcatgtcttgtcactgcgggcatcacatcttttgtcaattgctcggctccccgcggcgaaacgacgaaatctgcataccactttcgtaatcggctcgcagattaccgcgcgaatgacgaaacttcagtcttcctttcgccattcactcgcctatgcgcgcagtgataacgaaaccgcacgcatgacacgtctgcaaatcggcagatacgcagatacgaggaggggcggccgcgggaaaacggtcgccccagagagagaaggagatattataacagccggttgggtaatcggccattacgaatatgtcggcggttctttggagaaggggtgaaccgccacaacctctattatgctcccttgtgccgcacgggcaggcgtattcgcccatgcttcacagctctttcacacttgttcgcgcttgcccgcccgcggaaccggcgccaggttcaggattcctcggccgcgtcctccaccgtcaccgcggcggcgtcatcggcagattgctcggcgtcgtcgatcacttcgccttcgacctgctcgacgcgttcggtgtcgccagcgttgcctgcagattccgccgcagattccacggtggattccactgccacgtcgaccttggcggtttcctccgtcgtgtcggccgccggagcctccacactctcctcggcctccgcggccacattcgcagccaccgccgcggcggcaatctgcgcgagcttggccttgaccgccgcggacgagcccttcggcgcatgtacttcgggcgtgccatgcccgtgcttgttcgtgcgcacgaacggatcgccgcccttcatcgcgtacggatcgtcgaattccgcggagatcgtgggctcgtcatgcacaatgaacccgcgtcccttgcactccgggcactcctcggagaacgcctcgacgagcccctgcccgatgcgcttgcgcgtcatctgcacgagtccgagcgacgtcacctcggccacctggtgcttggtgcggtcgcgggccaggcattccaccagacgacgcagcacgaggtcgcggttcgccggcatcaccatatccacatagtcgatcatgaccatgccgccgatgtcacgcaggcgcaactggcgcgcgatctcctcgctcgcctccagattgcatcgcgtcaccgtctcctcgagcgacttgcccttgccgatgaaacgtccggtattcacgtcgatcgtcgtcattgcctcggtgcggtcgatcacaatggagccgccactgggcaggtagacctggcgttccatgcccttgcgcagctgcgagtcgatctgccacctgtcgaacacgtcctttccgccgtgctcttccgggtcccatctctcgagcttgttatgcaaatcgggtgccatgtggtcgaggtactcctcgatgcggtggtacacgccgtcgccttccacaatcatcttgttgaagtcgtcgttgaaaatgtcgcgcaccacgcgaatcgccacgtcaggctcgccctgcagcagcttcggacgcttgccgtgcaggaactcctcgcgcttgcgctgaatctcggcccactggttggtcagcccctcgagatccttcgcaatcgcctcttcggacgctccctcggccgcggtgcgaatgatcacgcccatgtccttcggtgcgatcttcgagacgatcgacttcaggcggttgcgttcgcggtcgctgagcttgcggctcacgccggtcatgccgccggatggcacgagcacaaggaagcgcccggcgagcgtcacctggctcgtcagtcgtgcgcccttgtgcccgatcgggtctttcgtcacctgcacgagcacgggatcgcccgacttgaatgcgagttcgatcctgcgcggctgaccctccaaacgcgtggcgtcccagttcacctcgccggcatacagcacgccgttgcgggcctgaccgatgtccacgaatgcggcctccatgctcggcagcacattctgcacacggccaaggtagatgttgcccacggtggcgacctcttggatgtcggagacgtaatgctcgacgagcacgttgtcttcgatcaccgagatctgcgtatggcgtccacgttcacgcacgaccatgagccggtccacgttctcgcggcgcgcgaggaagtcctgttcgagcagctggttctggcggctgcgttcacggcggttgtcgcgacggcgctgcttcttcgcctcgagacgcgtcgagccttcgacatcggtgatctcatcgatgtactgctgcttgcgtgaacggcgtggctgttcctcttcctcaccgcccttcgagttgcggcgacggcgacggcgacgcgtcaccgtgctctcgtcattctcctcctcgtcctcggcgcgcgaacggcgacgggtgcgggtgccctcctcgttctcggattcctcgcgttccgcattcgcgttctcctgcgacttacggcggcgacggcgacgcgtatggatgccgctctcctcgctgtcggattcgtcgcccgactttccggtttcgtcgtcgataggcgcatagacgatgtcgtcgagcacgaggtcttcctcgatttgctcgacttcggcggccgcgcggcgctcctgcgcgttcagtcggcgattgcgtgaacgcttgcgggagcgggtgctgccttcgttgagatcgagatcgtgcagcggctcgtcgtcggagccttcgtcattctcctcgtcgtgggtggaacgcgaacgtgccggcagcaccggctcctggaacagcagggaggtcatcgggcggccggcacggcgattgccgcgcgcgctgctttcctcctcgtcgttctccacatctgcagattcatgctgatccgcgtcttcgagcacctcacgacggcttgtgcgggaacgggaggtggaacgggaacgcgagcgtgaacggccgcggccggtctcgtgggtctcggcatcgtcgtcgaaagactcatctaacgcatcaagcacgtgctgggtgcggctctcatagctgtcgtcattggtctgctcagattcgtcggacaccgtgcggcggcttcgacgcgaatgggtgctgcgcggctcctcggcttcgtctgcctgcgcacgcgagcggcggcgcgtatgaacggtcggctcctcatcatcgttctgtgccgcgccccggccccggcgcgaacgcgtcgtcgtgggctcctctgcctcgtcattcgtggtgcgcgtgctgcgcgacctggtggaggtgctggcacggcgcgagcggcggcgcgttgccgtaggctcgttggagtctccggattccgcggattcctcctcgtggctgcccgcaggaagcgccttggtcggcttgccggcttcgattgcggcgcttggttcctggaacagcggcacgcggtcgtgcacttcgagctgcatctgggcgcccgcctcgccggcgcctctcaccacacggcgtccgcgacggcggcgtgtgggggtggaatcgttggtggtgttggtggtatcggtattgtcgaactcgggcgaacccaagccgttctcggtcaaatcgggcatatgttcctcgtgcggcgcgctgcaacggcgtcgcgaatcatggcttcgcacggtgtcaccccgccctctcacggcagtcgcgcttcgcgcccatggaagcatccaaaagtcaaatggtcgagggcggacaccagcgtgcggggaacctaagcgtgtgcgcgcgtgcacgtcgaaatgcatacgcatgcagtacggctcaaccgcgacgggatcgacgccatcgattgcggagcggcgttgcagcaccgctctctgcccagtatgccacaaggtatgcagattaaacaatctgttcacatccgtacggcaatgcgagaagattccgccaccatgcggacgtcattcactctcccctcgcggccccacactacactcttctccctccccctcctccacgccttcctctgcgtaaaaagagacagatagcagccactagatgtcccaaattacgtcttcttgcgtaaaaggggacaaatagaggcctccaaatgtcccaaattacgcagggaagagcaagagagcgagaaggaaagacagacgccgtgttctcatgctgctgcgctcagctcagccagtcgcgcagaatgccggccatgagcgtcagttcgccttccgccacctgctcgtcgtgcttgtgcgcgagcagtggcgaaccggcgccgaagttgacggccggaacaccgagctgcgagaatcgggcgacgtcggtccagccgagcttcgcctcggggtccttgccggtgcgtgccttcgccagagccgccagcgagcgcgtgagttcggaatccatgccgggtcgtgccgacggcgattcgtctttcatctcaatgccgaagccctcgaacacaccgcccgtcgcctggtgctcgccgttgccgagttcggcaccgcagtctgcgcccatcatcagcgccttcgcctcggcgagcgatttgtcgggagcgaaacggtagttgacgtgcacgcggcattcatcggggatcacattggtgcccttgccgccgctgatcagcgtcgcgttgagcccttcgcggtagacgagaccgtccacgctcacagtggcgtccgtatgctcgttcagacggcgcagaatctcggcggcgtcgtggatggcgttgtggcccatccacgcgcgtgcggaatgtgcggctatgccgtgcgtgaccacgtcgaagcggatcgtgccgttgcagccgccttcaatgccgcatgaggtgggctcgcctatgatcgcgaaatcgccggcgatccagtccgggtgcgcttcggcgaccttgcgcaggccgttcttctcggcggccacctcctcgtggtcgtagaacacgtaagtcagatcgtatttcgggttcgtcagcgtcgcggcaaggtaaagcagcacggcgtccgacgatttcatgtcggtggcgccacgtccccacaccacgcgttcgcccgggtgcgcctccgcgacgcccggcagaatgagcgggtctccgggttcgagcagtttcggcgggaagttgtcgatcaccggcaccacatcgagatggccggcgagcaccacgcgcctgtcacggccgagattcgtgcgcgcgacgagcgtgtcgccatgccgctgcacgtccagatgcggcagcgtgcgaaggaacgcctcggtcatgtcggtcagatgcgtctcgtcgtcgctcaccgagtacacgcgcatcacctgcatgcacaggtcggtgagcgcggcctgctcgcccacaccggcgtccaccgtcagcttgagcggctcccccgcgcgatcgatcacgtcttgcatagtccctccaaacgcctgccgcgcactcgcgcggtccattcgccaacactctaccagtgccgcgcgcatgcgggcgcatgcattccaaatgcatctgcgatgcgccagccagattccgcgcgcctgcatgcaaatgaaatctgcccgcatgaaatgcatgtgcgtgcatatacttgcactcggcagagcaggaacgcggagcaagggagaagcatgggcggcctcatcagcgcaatggagggattctgcgtcatcggcatcgtgatcgcggccggctatgcggccgcgcgtctgcagatcggcggcgcccaggcacagtatgtgttcaatcgcctgagcttcttcattgcgagcccgtgcctcatgttcgccattctggcgcaggagaacatcacacatctgttcgattccacgatcatcgtcgcgttctgctcggcggtcggcgtcggactcgtcttcctcgtgctcaacagattgttcttccacctcaaggcaccggatgccacgatcggcgtgcttaactcgctgtatttgaattcgaacaacatcggcctgcccatcgccacgtacattctcggcaacccggcgctcgtcgcgcccattctcgtcatgcagcaggcgctgttcacgccggtcggactcaccgtgctcgacgtgaccaccaagggcaagttctcggtgaagcaggtgctcaagcagccgttgcaccagccattgctcatcggcaccgtgctcggcatcatcgtctcggtcgtctcgtcgaaggtgggccatttcattgtgccgaacttcctgttcgacccgatcgacatgattggagattccgcggtgccgatgatcctcatggcattcggcatgtcgctgcacggcacgaagccgatgcagaacaagtcgaatctgccggcgatctggacggtggcggcgctcaagaacatcgtgatgccgctcatcgcattcggcatcgccttcgccatgggcttccgcgggcccacgctgtacggctgtgtcgtgctcgccgcactgcccaccggccagaacgtgtacaactacgcggcccgctacaatgtcggcatgaccttcgcgcgcgacggcatactcatctccacgatgacgagccccatcgtcatcgcgatcatcgccgcgctcctcagctgacgcctgctccttacgggatgtcatcaacgcttacgggatgtcaggttttcatattcttcgaagtagatcacaaaacaaacggctatgttccaacgatatcaatgtgaggatactcaatcgcgacatcccgtaagcgttgatgacatcccgtaaggattaagaattatgaggcgatgcgcaccactagtcgtcgcggcggcgcgagatcgaatcgaggcgcgtggcggtgtggttcgcgctcaccgcgccgacggtcaccagcgcatagcacagcacaatgccgaacaggcaacgcagcagcacggccgggttgctgagcatcgagcccaccagcggcagcatgagcagcaacgagcagcctgcggagatgacgatcaccgtgttgagcggcgtgagcacttccgagaaccgcgccttgcgcagtgtgagcgcatcggtgccttcgagcatgagcatgtggtattcgtcggcctggtcgaacacactggccgactgcatgatgcccgagctcaccgcggccagcacggcggcgaacaccagcgtgagcgtgccgccaagcgagatgtcgtgcatcatcatcagcgtctccgcgtcggcgtcgcccgatgccgtgcccagtgcgccgcatacggcggtgatgcccgcgatgaacacggcgagcgcgatgcccgagacattgcgccatgcacgcttcgggttgtcgagaatacggcgcatcgcaatcatcgtggcggcggatttcggccggtgcgcacgcgacttcgccacggcggcgatcacccacgaaccgatcacgttgagcagcatgaagcagccgccgatgatcgcgaacacgacaccatacgccaccgccacaccggcgccggccacgaggttcatgttattgagcatggcgaaaccgaacacgagggcgacgacgaacagcgccacgcgccatttgccgggcattgcggcgccttggcgggcggtgacccccaatggcgtgatggccaccttgcgcaacgtgagcagcgcggagaccaaggccagtgcggcaacgccgacgacggtgccgatgagcgcccacggccccacccacagctgttcgaagtcgaaggtgtggttctcgaagtgcagcatcatgatgagcggcatcacggcgaagtacccggcaatgcccagcacggagccgatcacggcctgtccgaccgcttcgagggcgatcagccgcaccacctgcgacgtcgtggcgccagccagtcgcagcaccgcgagtcgttcgtcgcgacgtgtggcggcaaggcgcgccgcagaacccgcgagggtggtgaagggcaccacgagcagcacgcaggcgaacatggcgagcaccacgtagaactcaccgttgacgctcacgttggcgtgcgtggagcaggcggaatcattgaagaagcagccgaccgtatggtctggtgacgcacgccagatgaagccgtgcagaccgccgagcacggtgaggaagatcgcggtcgccgcggcgaaggcgatgacggcgagcaggcctgtgtggtcgcgcggcgcatccggttcatcgtcatggtggaacatgtgccggtggaagagtctccacagtgcgaaggtgctcattgcaacgctccttgtggttgggcgcccatctgcactgcctgtgccggggcgtcgttctgcggttggcgctgcatgcctgcgcgccggttggccgcgtcgaggatcatgccgtcgcgcatgctcacggtgcggtcgcagtatgcggcgatgttcgggtcgtgggtgacgagcaccactgcggcgttgttcgcggccgccgcctgcatgagcagattcatcacctcgtgcccggtgttctggtcgagcgcgccggtcggctcgtcggcgaagatgatggccggattcacacatagtgcgcgcgcaatggcgacgcgttgcatctggccgccactcatctggccgggtcgattgcgcatcagattgcgcaatcccatgcgttccagccacatggcggcctgatcggtcgcctgcgagtacgccatgccgccgagcatgagcggcaatgccacgttttcgatcgccggcagctccggcagcagttgcccggattggaagacgaatccgaacgcctgcctgcgcatgcgggtgcgttcggcgtccggaatgcggtcgatgttggcaccgcggaacagcacttggccggccgtcggcttcatgatgccggcgagcacatgcagcagcgtcgatttgcccgaacccgacggtcccatgatcgccacgcgttcgccttcgccaagctggaagttcgcgtggttcagcgcgagtggctgacccatctgccatgccgcgggttgtgtcgccgccgggttgccggaagcgcttgtgttgtaatccatcaccaggtcgattccctgcagcgcgagtgattggcctcccatcggcgctccgtcagggtacggcatgggtgccgcagtcattgggggctgtggagcatacccgttgtggggcatggcatctgcgggggtttgcggcaagggatgcggcgcgttctgcggcgcctgtggcatcggcgcgccgggattgttgttctgcattgcgttcatgcttccaagctacggtgtcgcgcccgcacgccccatcatgcaacgggatgaattccccggcacaccacgcccgctctcagccttaaggatgatgcccaccggcatatcacgcgagatgccagctcacgcggtgcagatcgctcggcccgcattgcgcgatcgcctcgcggtgcgccttcgagccgtaccccttattgcgctcccacccatagcgcgcgtattcggcatgatcgcgcgccaactgttccatcagacggtctcgggtcactttcgccagcaccgccgccgctgcgacgctggcacactgcgcatccgccttgacaagcgtgcgcacctgtgccggcatgggcaccgcgggggcttcgaaagtgcccaatgccttggatatgtagtcgttcggcccgtcgagtatcgcgccgacgtgcagcccatccgcatgctgctgtggactgtgtttcgtatacgcccatgttcccgagtatttgcagcgctcgtcgaatccgcgaatctcgctgtcacccgggctacccatgccgagggcgcgttccacaccatcgagtgcgcgcagtgcggcgatgccgagcgcatgcgagatgccccatgcgtcgatctccgcattgctcgccgaaccgattgcaaaaccgtccacccacgcctgcaatggctcgtacagactctcgcgcctatgctcggtgagcgtcttggaatctgcgagatactgcggcatggcagtctgtgcttcgtcgagatttcgcgcaaggaacgcggccgcgcccaccatcaccggacctgccagcgaaccacgtcccacttcgtcgaatccgacgattacatcgaacccgtcggcggcaatctgccgttccaatgcaaacgacggcgccataccgcccctttctcgactccgaaaacccgcgcatccagcacagatcagcccgcgtcgggcacgttcgcgaacacgtcgctgtaattgctcagccacgagatgcggttgagcggccagtaccgcgcgaatgcgacgccggcgatgtcgcggatgggaacctgaccatgttgcgcatcgttcaaatggaagcgcgaatccgcggaattgctgcgattgtctcccatcacgaacacgtgcccctcgctcacggtgaccttgaacgggaaggtgctgggctggtccccgggcttgacatacgcggattcgtcaatcgccacgccgttgattttcaccggctggcccgccccctcgcactccaccgtgtcgccgggcatgccgatcagtcgtttgatcaagtagtcgctgtgataggtggtctcctcgctcgcgagccagttggaagggtctttgaacaccacaatgtcgccgcgtttgagcgcgaccggccgcggggagagcttggtggtgatcacacggtcgcctggcatgatcgtgttctccatggagcgtgacggaatcacgtacatgccgaatacgaagatgcgcagcagcaccacaatggccacgggaatcgcgcaccacaggaagaaatcccgtattgccgtcccccttgtcgaggcgagctgctgctccgtcccggcggagtccagattccccgcccccgcatcgcgattgccgtgcgtctccattggcgccggactctgcggcatgggctcgttcgaagaatccatgacccctcctgtcgaaatgattaccgcactccaatgtatcattttcggcggagacccactgtggcgttcaccattcacaacaaatgttccatggccgacaaatcgccggcgcgcatactgctctctgccgcagatcgccgcatatccgcccgcaaaagcaaaagccgggcccgaacacggaacccggccttcacaagaccgttatggcgaaactcacttggcggagttgtcgcggcgctcgacgatgcgagctgccttgccacgcagattgcgcaggtagtacagcttggcgcggcgaacgcggccacgacgaacgaccttgatcgagtcgatggacggggagtgcagcgggaagcggcgctccacaccggtgccgaagctgatcttgcgcacgatgaaggtctcgcgcacgccggcgccctgacggccgatgaccacgccggtgaaggtctggatacgggagttgttgccttcctgaatcttcacgttcacgtcgacggtgtcacccggacggaatgccgggatctcgtcggccggcttcatgtgcttggcgtcaaatgcctcaatagcgttaaccatggtgttcctctaccctgccgcatgccagcgtatggtcgcgacattcgcatgctcgcggatgtctggaatatcgccgcagatttgtctgcgacgcgcgtgccgatccgccgaaagtcaggttcggctggactcgtgggcaggcggattcatgcggcgatccgcgtgccggcacagcgacttcacattatacaaagcgcactggattacccacggcctccgacgaaccaagccgagcggaccgaccttgcatcacaacagggaagggcggcgacccacattcgtgaatcgccgccccaccgcgaattacagccagcgtgtgcggatcagaactcgcgcaccttgcggtagaagttgatcaggctgcgggtcgaggcgtcctgagctgcgagcgcctcgtcgttctgcgagatcgcaggcgtgatctgcttggcgagctgcttgccgagctcaacgccccactggtcataggagtcgatgccccacacggtgccctcgacgaacgtgaccatctcgtacagcgagatgagctcgccgagcgtgaaggcatcgagacgcacgccgaagatcgacgtggtcgggcggttgccggagaacacgcgggccggaacaatgtcttccggagtgccctcggcgcgcacctcgtcggcggtcttgccgaacgcgagcgccttggtctgggcgaagtagttgcccagcagcagttcgtgcatgtcctggtcgccatccttgagcgggttcggcgtgttcgcgaacgcgatgaagtcggccgggatcagctgcgtgccctgatggatgagctggtagaacgcgtgctggccgttggtgccgggctcaccccagaagatctcgccggtctcggtggtcaccggagtgccgtcccagcgcacggacttgccgttcgattccatcgtgagctgctgcaggtaggccgggaagcggtgcaggtactggtcgtacggcagcacggcgtgcgaggcgaccttgaagaagttgcggtaccacacgttgatcatgcccatgatcaccacggcgttcttctcgaacggcgtctcggcgaagtactggtcgacctggcggaagcctgcgaggaactcctcgaagcgggccggtccgaacacgatggcgagcgtgaggccaacggcggaatcgacggagtaacggccgccgacccaatcccagaagccgaatgcgttcgccgggtcgatgccgaagtccttgacgcgctcgaggttggtcgaaacggcgacgaagtgcttctcaacagcctcggccttctgctcggcggtgccgtcgatggcgccggaggcctgcagctgctcgagcagccatgcgcgggcctgacgggcgttggtgagcgtctcgagcgtgccgaaggtcttcgacacgaccacgaacagcgtggtctctgggtcgaggtcgcgggtcttctcggcgaggtcgttcgggtcgatgttcgagatgtagcgggccttgatgccggcgtcggcgtacggcttgagcgcctcgtacaccatgacggggcccaggtcggagccgccgatgccgatgttgaccacggtctcgatctccttgccggtcacgcccttccattcgccggaacggaccttgtcggcgaaggcgtacatgcggtcgagggtctcgcgcacgtccttgaccacgtcctgaccatccacgatcagcttgccttcgtcgctggcgtcgcggcgcagtgcggtgtgcagcacggcgcggtcctcggtgttgttgatgtgcacgccggagtacatgtccttggtgcgttgcttgaggttgacctcatcggcgagctctgcgaacagtgcgagggtctcaggcttgatcaggttcttcgagaagtcgaagcgcagcgtgcccacgtcgaaagacagcgagtccacgcgcgtgggatcgtcctcgaaccactgcttgagatcgatgccctgtgcctgcagctcgtcatagtgctgctgcagcttcttccacgccgcggtgcccgtggcgtcgacaggaggattgattgccattcgtgatcctttcatcatcagacaagcactgcggcgccgttgcccgtgctgcattgcagactagcaaggcatgcgtttgcatttgcttatcaagcttcaccatactcacaaaatacgacagttttgccccacgaccgcacacgaatcgtaaacagtgcgaacatcgggacgaaagcgaacattttcgctgttcgctttcacgcaggcaaacctatgaaatcgttttcaaacattcgcccgcgcatatggcgtcatccgcaagcctgtgtctcgtttcagttattggctctcacagtagttcgtcgcaccccgactccgcgagcgttttcaccattgacttgacttcctggctccgcgcacgtggcgtgatgagcaatgcatccggcgtatccaccacgaccatgtcgttcacgccaagcaacgcaacggttcgttcgctgttcggcaccacgatgtcgccggcggagtcgagtgtgaccacctgctcggtgttgcccagtattttcagattccgctcgtccacgctcggcaacagtgccgccaccgagttgaaatcaccaatgtcatcccagccgaagtcgcccgggatcatcgcgacgccgccctccaccgatagcggctcggccactgcgtagtcgaacgcgatcttctcgattccctgccagtacttgcgcatggcctcgtcgcggtgggcgtggaagtcgtcgggattcacggtctcgcgcacgttctcgccgcgctcatgtgcctcggcctgcgcgcgggcgagatcgcgatcgtcttcgatcacggcgtctgctatcgcatcgatcgcgcgtgcgagctgtggcttgacccggtgcaggtggtcgagcagcacatcggcgcgcatcacgaacatgccggcgttccagcggtattcgccggtgttcaggtaggcctgcgcggtggcggcgttcggcttctccacgaagcgttccacgagcacggcgtccggggcgtcgggaacgcgggccgcgagcgactcgccttcgtggatgtagccgaatgcggtgctcgggcgcgaggctgctatgccgatggtggtcacatagccggcgcgggcggtggcgacggcctgccgcacggcgtcgacgaacgccaccttgccgcggatcacatggtcggcggcgaacgatccgaccacaatgtcgttgccgtgcctgcgggcgagcacggcggtggcgagcgcaatggcggccgtggaatcacgcggtgccggttcggcgaagatgtgttccggcgccacctcgggcatctgctcctccacggcgtccacatgccgttcgccggtgctgatgcacacatggtccatgccggcgatggcggcgaggcggtcgaaggtggactgaatcagcgtgcgccccgacccgagcaggtcgaacaggaacttcggtttggcctcgcggctcagcggccacaggcgcgtcccggtgccgcccgcgggaatgatggcgtagaaatcgtcgaatccgttactcatgccctcattctatccgctcgcgcgcattcggctccctcatgctgcccaaacgcgacacgccgattcgtcaaatccagcaattcggctacactgtatttcttgtgcaccaagcatgtgccactttagctcagtcggtagagcggctcactcgtaatgagcaggtcgacagttcgattctgtcaagtggctccattgccctagacgtcggcgcaaacgcgttcgccgcctagggttttgcatatccaacgcgcgcgagtggcgtaattggtagccgcgcaggatttaggttcctgtgacttcggtcgtgtgggttcgagtcccatctcgcgcacccttctccacgttctccccatgtttccagattgtcccgtggacgttctccccatgtttccagattgtcccgtggacgttccccctcacccgagccatatcccggcgtaggctgtactccgtgacgctcctacaaccgatcgccctcttggctatcatcatcgccggctacctgttcaaacgctgccggttgttcggccagcgcgattaccgcatcattcaggtgatgctcttcgatctcgtgctgcccggtgccatcgtctactcgttcgccacgaatccgcatgatccgtcgctgttatggctttcggccttcggtttcgtcgtggcgctcgtgccggtgctcgtgatcttctcggccacccgtcactcgccggtcacgcagcgcgcgttcctcatgctcaatgcgaccggtctcaacataggctgcttctgcttcccggtggtgcaggcgtttcttggcgaacaggcgatcgttcccgccgccatgttcgacattggcaattgcatcatggtggccgccggcacgaatgtgatgacgcagacgctcctgcacattcaacccggccgtcccctcaccgagcaaggcgccggcgacgctcccacacttccctacacgcgccccacggaccgcgatgccaagcgtctcgcccggcgttcgctgctgcacacggtgctcaagggttttgtgggttccattccgttcgacacgtatgtgatcatgatcgtgctcatggtctgcggactgtcgctgcccgcctggttcgcggatctcttccggccgctgtcgaatgcgaacgcctgcgtggccatgctcatggtgggcatgatgatggatctgcccgcgaaccgttccgacaccttcgccgtgctcaaggtgctcgcctggcgtcttcccttcggattggcgttcgccgccgtggcttggttcctgctgccgttcgacgccggcattcgcgaggcgacgatgatgtgctgcctcgccccggttgccgtcttctccacgctgttcaccgacgaggtgctcggcaacgcccgtctcgccggcttcacgctgtcggtgagcgcggtgatcagtcttggcatgatgaccggcgcccacgcgatgatcgccgccggcatcatctgattcggtaccggtgcgggctgacgcctcggctacctgccgagcagcttgtgcgcgaggcgctgggcacggtaggtgaccggccgcagcaccttcatgaagtcgcccggcatctccaccacgtagccgttgaatccctgcttgaattcgagcacgccgcgtccctcgtcatccgggtcgtcgaaaatgccgtcgatgccgtagaagtcgtacagattcacatgcccgaacggttccacaccctgcacgcagtaccgcagcatcgcctcgtgctgaatgagtgccgatgcatagaacggcttgtattcctccacgctgcccgagaacaggtagaccacttcgcgcgggccgagcacgaacatcgaggcggcggccggaatgaggtcgcccttctccacgagctcgttcgcctccgccaaccgcttgttcgcggccgccagattgctcgattcctcgttgagcctgcgccgtagcttggtcgtctcgcgctgtgcgatcttcgcttcgagcccgtcgacgagcgcgcgcagatcgtcggccttgcgctgcatcgaccgctggtattctgcggtgtcgatctcggccagcacgaatcgggcccgttcgccgaagcattgcgcgaactgtttgaaatactgcggtccgcggaattcgaaatgccggcgttccgcggtctgctgttctatccgcgcgaaggtgtcgagctcgtcgacgccgatctcgcgcacatgcacacccatcgacctggcgcgtttgatgctccactgcgtgcgtttcgaatacgacttgagcagctcgctttcgtcgccgatcccggtcatgtccttggcgaaccgccagcgcacggtcgacgtgtagccgcgcacgaatccgccgtgctcgtatcctgcctgttcgatgttgcggatcatgcgcttgtccggcgcgccgccctcgctctcgggcagcgcctcgccgtggtcgtcgcgcacgcggtagcgctggttcggcgcgatgtcgaggtgcacagcgcccttcttcttcgcgaatcgggcgagcgcgcgcaggaattcggcgacgagctcgtcgtcatcgtagtcgcacagcgggccgctgatcacgctgcagaacgtcgccatcggcgcatgatgcgtggcgaacacggcccccgccttgatctcgccgtcctcgcgcatgcccacgaagtcgacgtccatgccgtgcatgcggcgcagattcgccatctccacggtctgctggaaattcgactgcggcgacgcctccgcgaatgcacggaattcctgctcgttcaacacttcaaaagaaaacttgcgcatatgtcctgtattcggtctcgggtttccagattgcttccggctcactcaccggtctccacgagttcgcggatcgccggcatgagcgcacgcagcgccttgccgcgatgtgagatcgcgttcttctgctcgggggtcatctcggcggaggtgagcagttcgccgctttcctcggctccggcaggctgctcgtcgggcatgaagatcgggtcgtagctgaatccgttgctgccgtgcgggtggcgcacaatcgtgccgggcatctcgccgagcaccacggtttcacgggcgtcgacaagcccgtcgccatcgtccatgccatcggacgggtccgcctcgaagtccgcgacgtcctcctcggctgcaatcggcaccacgagagcggcggcacagcggaagcgagcggtgcggtcgtcgtcgggaatgtcttcgatctgggcgagcaataggtctatgttcgccgcgtcgttgccatgctcgccggcccagcgtgcggaaagaatgccgggggcgttgcccatgacgtccacgatgagtccggagtcgtcggcaatcgccggcagaccggtcagcctggccacaaagcgcgccttgagcagcgcgttcgcctcgaaagtgatgccggtctccaccgggtccggcagcccgagcgagcctgcggagacgagctcaatgtcgtgcgcgccatcgccgaattcctcggccagaatgtcgcgaatctccaccagtttgccttcgttgtgcgtggcgacgacgatgttcatatgcccaccattcccttattcgaatgtgctagcgcaggtcggcgtcgagcgcggcctgctgtgcggcttggagttccctattgcccttggtggcgaggtcgagcagcacgccgagctcgttgcggctgaatgggcgatgttcggcggtgccctgaatctcaacgaatttgccggatccggtcattgcgacgttcatgtcggtcattgcgcggctgtcttcgacgtacggcaggtcgagcatcggttcgccgtcgatcacgcccaccgacacggcggagacgctgtcgagcagcacgttcttcacgcttttgatcttgccgttctgcttcgcccagttgagggcgtccacgagggccacgtgcgctccggtgatcgacgcggtgcgcgtgccgccgtcggcctggagcacgtcgcaatccatctggatcgtgttctcgccgagcgccttcatgtcaatcacgccgcgcaggcatcggccgatgagtctggagatctcatgggtgcggccgcccaccttgccgcgaaccgattcacggtcggtgcgctgtgcggtggcgcgcggcagcatcgaatactccgcagtgacccaaccgagcccggagtccttgcgccagcgcggcacggtgtcggtgaacgtggcggtgcacatcacgcgcgtgttgccgcattcaatgagcacggatccttccggcacgtcggtgaatgcgcgggtgatgcgcacgggtcgcagctcatcgtatgcacggccgtctgctcgggtaacagtcatggtaatcctctcgtcgttctctcacatcataggccgagaggcaacatcggccgaatgcgaacgaatgtgttcaaccgtcatctgccgccacctggcgccagcgcaccccactcctgcaagccactccaaccctagcccgtaagggggtgggatagccggtagcgagaagcgggccgcgagaatctgcccatctgcaatcgttcggatgcctactctgccgccgatttcgcaggaagcgcacggtcgaacaggcacagcaccacgccgacggcgagatagatggcgacgatcttgaggcaggccacgcccgcgccgccccaggtgaattgcgtgatgatgagatagtcgtaggggtaggcgttcgccgtggggccggaatgcgggaaccagtaggcgcgcgcaatcgcgaacgctgcatagagcggcaggtacacaagccagacgagcggatacaccggcttgaacgcacggtgcggttcgaatgcgaagaagtcgacggcgagcatgcccaccacaatcaacgcgagcacctgtgcgctgagcgggatcacctgctgcgccggcaccccgaactccgcagccggcgtgacgaagaaatgcacggcggccagcgagaacgcgtaggtgagcacgaagccgcgcagcaatgccggcggctgcacaccgcgcagaatgctcgcacagccactccacagcatgacgatgccggcgatgaagccgatctggtacatgaggaacgcccaaaggctcacggcatgccatgccggcgatgtgccgatgaagcacagcgcagcaatggccagtctccagattcctgcaagatatcgcatgttcccatcctaccggcccatctgccgagcgtcctctgcacgccacacacgccactgcccttttgcgtaaaaagagacacacaggcctccgatttgtccctttttacgcaacaagaggcagagagagcagaaaggacctcatccccgcacgagtaagactccgaataatgacatccgcgcatatttgcgcgctcattcgactaggctggggaacaacgacatccgcgcgcggcgaatccacggccgccccggccaatcgcgaagagatcacgcaagagaagcgcaccgctaacacaggagacaccatggtggtttacgacccgtcgctcatgaccgacatgtacgagtacacaatgcttgacgccacattgcaggacggcacggcgaaccgcccctgcgtgtttgaggtgttcacgcggcatctgcccgagggacgtcgctacggtgtggtcgccggcattggacgtctgctcgacgcgctcgaggacttccatctcgatgacgccgacctgaagttcctctctgaccgccacattgtgagccggggcaccgtcaagtggctcgagaactaccatttcacgggttcgatccgcggctaccgcgagggcgaggtgtacttcccgaattcgccgattctgcaggtgcgcggttccttcggcgagtgcacgctgctcgagacgctcatcctgtcgatcctcaactacgattccgccgtcgccgcggccgcctcgcgcatggtcacggccgcgaagaaccgcccgtgcatggatatgggcggtcgccgcacgaacgagtgggccgccgtcgccgccgcgcgcgcgtcgatcgtgggtggattcaagggcaccgcgaatctgctcgccgccaaactgtacgacctgccggcgatcggcacggccgcgcactgcttcacactcgtgcatgacagcgagcgccaggccttcgaatcgcagatcgccgcgctcggcacgaacacgacgctgctcgtcgacacctacaacatcgaggaggccgtgaagactgccgtcgaggtggccggcccgaatctgggcggcgtgcgcatcgactccggcgatctcgccgcgctcgcccagcgtgtgcgcaaccagctcgacgcgctcggcgccacgaatacgaagatcacggtgacgaacgacctcgacgagtatgcgatcgcctcgctgcagaccgcgccggtcgactcctacggcgtcggcacgcagctggtcaccggttcgggggcgcccacctgcgccatggtctacaaactcaccgaacgcgcgaacaacgccggtcatatggaaccggtggcgaagaagtctgtggacaaggcgacggcaccgggagccaagctcgccttccgttcatacgaatactcgctcgccgactgcgaacacgtcatctccggctcggagagcgcgctcgagaacttcgtgccgggcgagggctgggaagatctgctcaccgacttcgtcgtcaatggcacggttgacccgcagttccagggtcacgacgggctcatggcggcgcaggattaccatgccaaggcgctcgccaagctgccgatcaccgcgcagtcgctcatgcgaggcgagccggtgatcccgacgaagctcgaggtgctctgatccgcaattcgcggcacgttcgcggtatgctggagtcggcatatcacacgcaagcacagaaaacaaagaggttccgatgccagatttcatcacgcactattcgcccgccccggaccgctacgaccgcatgcagtacgcgcatgtcggcacgagcggtctgcaattgccgcgcatcgcgctcggcctgtggcataatttcggtgatctgacgccgtatgggcagatgcagcagatcgtgttcactgcgttcgaccacggcatcttccatttcgacctcgccaataactacggccccatgtacggcgccgcggaacgcaatttcgggcatatcatgcgtgagagtctgcgaccgtaccgcgacgagctcattatctccacgaaggccgggttcgacatgtgggcgggaccgaacggcgtgggcggcagtcgcaaatacctgctctccagcctcgaccagtcgctcgaacggctcggcctggactatgtggacattttctaccaccactgccccgacccgaacacgccgttggaggagacggtcggcgcgctcgagaccgcggtgacgagcggccgcgcgctgtatgtggggctttcgaactacgatggcccgctgctcgaacaggccgcgcagatgctcgccgagcgccatgtgccgttcatcatcaaccagaaccgctacaacatcttcgaccgcacgatcgaacgcaatgggctcaaggaggcgacgagcaagctcggcaaggggctcatcacgttctcgccgcttgagcagggactgcttacgaaccggtatctcaacggcattcctgccgatagccgcatcgggcacgacgaccggttcctgaacaagtccgcgctcaccgagtcgcgtctcacccagattcgcgaactcaatgacctcgcgctttcccgcgggcagacgctcgccgagatgtcgctcgcgtggctgctcaacgaccctgccgtgaccaccgtgctcgtcggcgcttcgaaaccgcagcagattctcgatgacatcgccgcgctcaacaacacgcacttcacgccggaggagctcgccaggatcgattcgatctcgctctaattcataccgttacgtaatactgttacgggctagggttccggcttatggccagggcacacaccacggaaatcggagtgtgtgccctggccataagccggaaccctagcccgtaacagacagctggcggcgatggattacttcgtcatctcctcgtatatgcgcttgcactccgggcagatcgggtagtccttcgggttgcgcttcggcacccacaccttgccgcacagtgccaccaccgggcgccccgtcaggcgcgactcggcaatgcggtcacgcgacacgtaatgcgcgaaccggtcggcgtcgccgtcgtccgcccgccgctcctgtgccttcggcctttcgagcaccgcggtaccggtgtcgctgctcggctcggttgccgccgtcgtgttgtcgtcgagcgcgtcattgtatgcaaagctcatgattcctcctgttcggctatacaatcctgcaacttcgttctctattcctgtctacagattctacgcccagcccagttcgccccatctgcgtctcatctcatagccccgtgccgcatctctttcccggatttcccggccagccaattgcatagccccaccattaggctgtagagatatgacaatcgctgtatgccccggctcgttcgaccctgtgacgaacggccatatcgatgtaatcacgcgttgctgccgcctgttcgacgaagtgcatgtggtggtcgcggtgaatgccatgaagaagccgctgttcaccgaaaccgaacgcgtggacatcatcaaacacgcgctggccgactcgggcatgacgaattatgtggtcgcatggaccgacggcctgatcaccgactactgccgcaaggtcgactcccccgtcattgtgaaggggctgcgccagaacggcgactatgaggccgagctcggcatggcgctcgtgaaccgtcacctcgcctatgtggagacgatgttcctgcctgccaatcccgttctggaacacatctcgagctccgtggtgaaggacgtcgcacgtcatggcggtgacatcaccggcatggttccagactatgttgtgccattattagagaaggcgctgcgttagtagcgcgaccgcggacctatgggtatgcgcccgcgttgagaggagagagcatgactcagaacgattcgagcacgcagaccattcacgacggcggcaacgacgccccgcaaccaccgcaggactcctccgcccgcagacccgcgttcaacatggacgatctgccggatctgcgcgacaacgcccccgacccggatgcgctgcgcaaggccgagttcaccacggtgtacgacatcatcgactcgctcgaggagatgatcacgagtgccaaggggtccatgttctccccgtccagcgtgaagattgaccgtgacgatttcctcgacaagctcgaggatctcaaaaccaagctgcccgtgcagctcgagcgtgcgagcgcgctgatgcgcgaggcggagggcagactcgcgaacgcgaattcgcaggcgaacgtgatcatctccaccgcgcaggcgcgagcggcgaacatcattcgcgatgcgaacgagcgcgcggactatctcgcctcccaggagaaggtgaccgagatcgcgcgtcagaaggcgaagacgatgatcgacaaggcgcaggccgcgagcgaccgtcttacctcgggcgccgaccagtactgcatcaagatcatgaacgagttgcacagtcagctcggcaagatgacgcgcgacgtcgaaggcggcctgaacgtgctcgaggagcgcgaggcaaaggcgcgcgaggagctcccgcacgccgaggaatccgactatccgcaggactgacccgttcgcgtcacgcggaatagcgacacggcggcgcgggttgactgagcgtatcaagcaatccaagcaaggtggaacaggcgaatggcacgtattgaatacacagattggacggttccggtggcccaggtcggctcgcgcgcgggccagaccatgcaggtcgaccgtgatttcccggcacccggcggcatcggcgactcgatcgtgggcgtcaaggaaggcgaaccgatccatgtgaacggccagttcgactcgattatcgatggtctcattttcaccggcacgttcacggcgccggtcactgcggtgtgcgcgcgctgcgacagggatctgagcggggactggagcgagcaggtcaccgcgttcttcccgtatgaggatgccgatgccggcaagaccaagaacgaagatgtggagatcatcgccggcgaggaggagtcgggcgacacgtacccgctcatcgacaacggcgcgttcgcgaacatcgagccgctgctgcgtgacaccttcgtgagcgcgttgccgctcaatccgctctgcaagccggattgcaagggtctgtgcccgcagtgcggtctcgatctcaacgagagtcccgagcatgtgcatgaggtgaccgacctgcgtttcgccgatctggaggcgctcaaagagcagctcgaacgcgagcagggcgagtgagacgcgcgtttgtacagcatatgcgttaagattctgaacgcttaagctcatatgttcgaacgaaacagaggataaacaatggcactgccaaagtacaagatgtcgcgcgccaatacgcgtacgcgtcgttccacctggaaggccaaggctgcccagaccatcacttgcccgaactgcggcgctccgacgctcgctcacgtggcctgcccgagctgcggctcctaccgcggccgcgtctaccgcgaggcgatccgttccgcccacaccaagtgagttgaacttcacgaaatccctgccatcgacgggtggcggggatttttttatgcgcgcagattgtttcggctttacttgcgtaatcggagacgaaatacccacccaaactgtccccatttacgcagattcccctcaccttgcatgtctcatacccgctgcatctcttatacccaccgcatctcccgccctgcgtaaaaagggacagattattcggtcaaaccgtccccgattacgcaaaggaatcttctccctgtacggagggcgcgcgtagggcacacagactacactgtgcaaggaagccaaatcgagggaatctggagcattatgagtgttcgtgtaagcacgcaggaaatcggcgaatcggcaatgcaggagctgttcaccgcgctcggcaccacattggagaccgatctgctcgtcgaggcgctcacccaccgctcgttctcgcacgagcacgagggtgtgaagaactacgagcggcttgagttcctcggcgacgcggtgctcgaattcgtcgtcaccgagacactgttcaagcagtatcccgacaaaagtgagggccagttggcgaagattcgcgcgaaggccgtgtcggaggagtcgctgagcgcgatcgcgcgcgaccggctgcacgtgggtccctacattctgttggggcacggcgagagcgagcagggcggcgccgagaaaagctcgattctgtgcgacatcgtggagtcgctgatcggcgcgaccttcgtgcagtacggcgtggacaaggcgcgcgaagtcgtgcatcatctcgtcgacgacacactcgccgaggtggccaccgaaggtccggcgctcgattggaagacgtcactcacagtgaaggcccacgagatgggcttgccggaaccgcggtaccagatgtccgtcggcggaccggagtacgcgctcgaattcaccgcattcgccatgctcggcgattccaaggaggtgctcggcgtgggcaacggcagcagcaaacgcaaggcgcagctggccgcggccgaacaggcgtggcatgtgctcgacgagcgcgagcatgcgccgaagcccgagcgcaagcgcgaacgccgcccgctgaccgacgcctgagccgcacgccctgcgccgcacagccaacaccttacgggctagccttcctgttacgggctaattttcctgttacgggctggcattttctgttacgggataggtctcacgcgaagaattcccctcgtcggaattgcaaaaccgccattttccaagggccattgttgaagaaaatctgcatgcccctagcccgtaacagaaaatgccagcccgtaacaggaagaagcagggcatatccataaatgcattcagcatgcggtcacaggagccgcaccacggtgaaatccagtaggatatcaacgcaaggcccggcgcgggacgcgaatggcacccgcagccgatgccttgaatacaagacatctcacgaaagagggaaccgtgtcaccaacacccctgcaggcgttcagcggcgtggccaaagcgaacgccaaccagcatacgcacaagcgcaccattgtcgacggcgagaagatgaccggcgcacaggcgctggtccgctcgctggaagacctgggtgtcaaagtcgtgttcggtattccgggcggcgccattctgcccgtgtacgacgccattgacgagcacacgaagttccgtttcgtgctcatgcgccacgaacaggcggcaggccatgcggcggagggttacgccgtggccaccggcgaggtgggcgtgtgcatcgtcacgtcaggcccgggcgccacgaacgtgatcaccgccatcgccgacgcgaacatggattcgatcccgatgatcgtggtcaccggtcaggtgggcgtcaacgccattggcaccgacgcgttccaggaggccgacatcgtgggtgccacctacccggtcgccaagcattcctatctggtcaccgacgcgcaggacattccgcgtgtgctctccgaggcacactacatcgcgcgttccggccgtcccggaccggtggtcgtggatctgacgaagaccgcccagaacggcaccatgtattacagctggccgcagcgcatgattctgcccggctacaacccgaccaccgaggcgcatggccgcgtgctcgacgatgccgccagactgttccagcacgcgttccgcccggtgctctacgtgggcggtggcgcagtgcgttccgacgccggtgccgaggtgaaggcgctctccgatctgaccggcgccccgattgtcaccacattgccggcgcgtggcattgtgccggatgatgaccccgccgtgctcggcatgctcggtatgcatggcacgatcgccgcgaccggcgcggtgcagcgctccgacctgctcgtcgcgatcggcgcgcgcttcgacgaccgtgtgaccggcaaactcgaggccttcgcccccggcgcacgcgttattcacatcgacatcgacccggccgagatcggcaagaaccgcactcccgacgtgccgatcgtcggcgatgtgaagacggtgctgagcgcgctcatgccgcgcatcgaacgccagcacgccattcacggcaagccgaatctgaccacatggtgggggcttatcaactcgtgggtcgagaaatacccgctcacctaccaggagccgaccgacggcacgcttgctccgcagtgggtggtcgaggagctgtcgcatgccgcgaatccggagacgatctgggtgtccggcgtgggccagcaccagatgtgggcgacgcagttcatcaatttctcgcacccgcaccagtggatctcctcgggcggcttgggcaccatgggcttcggccttccggcagccatcggcgcatccatcggctcccagcgctacttcgacggcaagaagccggtgtggctcatcgacggcgacggatcgttccaaatgacaagtgaggagctcgccgccgcgttcctcgagggcgccccggtgaagattgcgctgctcaacaactccgtgtatggcatggttcgccagtggcagaccctgttctacaacaaccactactcggccacgattctgcatgaggaggagaagaccggcttggagggcgttccggacttcgtcaagctcgccgatgcgtacggctgcgttgcattgcgcgcgcgcaccaaagacgaggcggtagaggcgattcgccgggccaacgagatcaatgacaggccggtgctcgtcgatttccgtgtgtggaaggatgccatggtgtggcccatggtcgccgctggcgattcgaacgacaacgtcacctacctgcccggcatcaaaccgttgcaccaggctgacggccttgccgccatgccggtggattccgatgcgcaggcagatgaggctaccgccatcatcaccgaggaacaggactgaaaggggaaggtcgaaatggcttcatatccagcatccaagccgggttcccagcgtcatacgctgtcggtgctcgtcgagaaccgcccgggtgtgctcgcacgcatcgccggcctgttcgcccgccgtgcgttcaacatcaactcgctgagcgtctcacccaccgagcgccccgacatctcccgcatcacggtgaccgccgacgtcgaggaggtgccgctcgagcagatcatcaagcagctcaacaaactgctgcatgtgttgaaaatcgtcgacctcgacgaatcgaccaccgtcgagcgcgaactcgtgctcatcaaggtcgccgcggaccaatcgaaccgctccgatgtgcttgagatcgtcagactgttccgcgtgcgcgtcgtcgatgtcaatcccgagtcgctcacgatcgaggcgaccggcgccggcggcaagatcgacgcgctgctcggtctgctcgaccactacggcatcatcgagctcgtgcgttccggcgcggtcgcgatgacccgcggcccgcgcgcgctgagcgagaaagtggtcggcagcgagatcaccggccgctgaatctgcgttccgcattccatattctgtgtaaaggggacagtgagaagcttctcactgtccccttctacgcattctgatgcatgctttccgcatgctgacacctgttttccgcattcattcacccgtcgtccccacaccgacagccgaattgttaagggcaatgagacaatgaaaccatgacgaaaccggaagttcttattctgcaacatgccgagtgggagaaaccaggactcattctgtccgaccttgaggagatcaatcttcccacgcagacgctcaatatatcgaagcagaagaaacccgaccttcccgatttcgacgaagtggccggactggtggtcatgggaggccccatgggcgccgccgatttcgacgactaccccggtctcaaggccgagatgaagctcatccgcgcggccataggcacaggcaagccggtgctcggcgtctgcctggggcatcagctcatcggcgccgcgctcggtgccagggtgaagaaggccagcgcgccggagatcggcatcgcgcccatcaaacgcgtggccaaacacgacttcttctccatgtggagcaaggaactcaacgtgctccaatggcacggcgactgcatttcgctgccggattccgccgagctcctcgcccgctcctccgacacgagagtgcaagcattccgcttcggctccgcgctgggcatgcagttccacttggaggtcacgccgcagctgctcgaggaatggcttgacgaaccgagcatggtcaagcaactcaaggcttccggcggctcgaaatcgcagctgcgcgaggcgttcgccgccagctacccgcaaatccagccgctcggcgaacaggtcttctccggtttcgccgcccgttgcagcacctacagtttctctctgacatcccgtaagagttgacgacatcccgtaaggaagatcagaatgcgcgatgttctctgaattccttgatattccttgatattccttggaattccttgagattccctccatctcccccgtgatttgttttcttacgggatgtcataaactcttacgggatgtcacgaacaatgaaagattgccatgccaacttttgatttgggactcgaacatgtctcgctcgacttcgccacgaagaccattttcaccgacgtcacgcaaggcgtgttcgaaggcgaccgcataggcatcgtcggccgcaacggcgacggcaaatccacgctgctgcacctgctcgaaggcacgcaggctccggattcgggccgtgtcaccacgcgcaacggcctgacgttcggcatgctcgaccagcgtgaccagctcgacgatgacgccacgatccgcgaggccgcgctcgaaggccgcgaggattacgaatgggccgcgcagacggagtcccgcgagatcgtcgaggcgctgctcggcggcctcaatctcaatgcgaggatcggcacgctctccggcggccagcgtcgccgcgccgacctcgcccgcctgctgctcaaggactgggatgtgctcgcactcgacgagccgacaaaccacctggacgtcgtgacgatccactggctcgccgaacacctgaagaaccgttgggcgaaggggaccggcgcgctgctgatcgtcacgcacgaccgctggttcctcgacgaggtgtgcgagtcgatgtgggaggtgcatgacgggcagatcgagccgttcgaaggcggctacagcgcgtacatgctgcagcgcgtggaacgcgaccgccaagccgatgtgcgcgagacgaagcggcgcaatctggcccgcaaggagctggcatggctgtcgcgtggcgcgcgtgcccgctcgaccaagcagaagttccatgtgaaggccgcgcgcgagctcatcgccgacgtgccgccgatgcgcaacacgctcgaactcaagcagatggccacttcgcgccttggcaagcaggtggtcgacctggtcgatgtgacgcagattttcgaccgcgaacagggtgctgtggccgacatcgaccccgacatcgccgacatggaacgcatgggcacggactccgaatcatccgccggcacgcagattgacatcgtcaccccgatggtccaagaaccgcaggctttcggctcggtgacgatggatgtcgacgatgccgacgacccgcgcctcatctccgcattcggctcgcgtgccgcgcaaattgccgccgagcatgggctcaaggcccgcgaggccgtcaccggctacaacgcgctgcgtggcatgaccgagaacgagctcgctgccaacgaagccgcgaacaccggcgccgacgccacgagtgccgccgcgcatatcgaggtaagcggccgcgagattctcgacgacgtgacctggctcatcggccccggcgaccgtttcggcatcgtcggggcgaacggcgccggcaaatccacactgctgaagattctcgacggctcgctcgcccccaccgccggccgtgtgaacatcggcaagacggtgaagttcgcggtgctctcgcagcggctcgacgaattggagaagctcggcaactacaaggtgaaggaggtgctgagccgctacaagcccacctacatcgtcgacggcaaggaggtgacgcccggccagcttatggaacgtctcggattcgagggagcccagttaatgacgccgatccgcgacctctccggtggccagaagcgccgcatgcagctactgctcattctgctcgacgaaccgaacgtgctcatcatggacgagccgggcaacgacctcgacaccgacatgctcgccgtgatggaagacctgctcgacacctggccgggcacgctcatcgtggtgagccacgaccgctacctgctcgaacgcgtcaccgacgagcagttcgcgctgatcggcggcaaggtgcggcatctgccgggcggcgtgcaggactatctcgatatggtggacgatctcaagcgcggcaaggcgctcccgcaggcggattccgcggatgctgcgcaatctgcgcacactgcgcaatccgagaacgtgcgaactgccgacgagcagtctgcagaccagccgaagctctccggcaaggaatatgcgcaggcatcgcgccgcgtttcggcgatcgagcgcaaactggagaagatcgagcagcagaaaggcgagctggaatcccagatgaacgcgcacgaccccaccgattacgaggggctcggcaaactgagcgcgcagatcgccgaactggagacgcagcagggcgagctggagaccgagtggttcgatctgtccgagcaactcggcaagtgagtatgcgtgcgggcgcggcttgtcgccgaagagcaatacgctcagactatgacacacgcgcaatcacacactacagaccaatttgacgaaacgctcgccgccggcaatcacggcgttgccaatgcggccgtcgatttgaagctctacgacacggcgacgcatgcggtctcgcgtttcgagccgatcaaacccggcgaagtgggcatgtacgtgtgtggcgcgaccgtgcagagcgccccgcatatcggccatattcgcgcggccgtcgcgttcgacatcattcgccgctggtttgagcggctcggctacaaggtcacgttcattcgcaatgtgaccgacatcgacgacaagattctcgacaaggccgccgcagcgggcgaggattggtgggcacgcgcataccattacgagcgcgagttcacgcacgcgtacaacgagctcggcgtgctcgcacccacgtacgagccgcgcgcgaccgggcatatcatcgacatggtccacttgatcgagcgcatcatcgacaacggccacgcctatgtgatccgcgacgagcacggcgaactgaccggcgacgtgtatttcgacgtcgcctcctggccgcactacggcgagctcacgcaccagaagcagaccgccgaggttgacgaggccgccgccgtggccgatcgcatgggcccgtcggtcgacgcctccggagacgacaaatacaatcccgccgacccggccgacctttccgagaacaagcgcgacccgcgcgacttcgcgctgtggaagcgcccgaagagcaccgatcccgccgacgcccgctggaagactccgttcggcacgggccgcccgggctggcatatcgaatgctcggcgatgagctaccgctatctcgatggcatgttcgacattcacggcggcggtctcgatctgcgtttcccacatcacgagaacgagatggcgcagacccgcgcggccggctaccgcacggcgaaccgatggatgcattcggcatgggtgaccgccaagggcgagaagatgagcaagtcgctcggcaatggcctgtcggtgccggtcgtgctcgccgagcattccgcgtgggtggtgcgctatgcgctcggctccgtgcagtaccgctcgatgctcgagtggagcgaccagacgctcgccgaagccgaggccgcatacgagcgcatcatgaacttcatcgggcatgccgcggacgcgctcggtgagcagccgtcgcgtgacgagatcaccggcgtctcggccgacaatctgcccgtggatttcgtcgccgccatgaacgacgacgtgaatgtgtcgcgcgccaccgcagcgatcttcacgcagattcgcgagggcaacacattgcttgcgcgcctcgcgggcaacgccgacgacgcggaccgcaccgcattgcgtgccgcgctcgtcaatgtgcgcgcgatgctcgacacgctcggtctcgacccgcttgccagtccgtggattgacggcggcgacgaggccggcggcgactccagcgcgctcaaaacactcggcgaactcgtcgacgcgcagctcgccgcccgcgccgaagcccgtaaaaacaaggatttcgcaaaggcagaccagattcgcgacgctctcgccgccgccggcatcacaatcgaagacggccccaccggttccacctggaccctcgccccctcccgctgattgcgcatccctccctctggaaagcccctctgcgtacatgaagttcctttgcgaaagggacttctttgcgtaaatggggacagatagcggttctaactgtccccatttacgtccaattcagcgctctatccccggtataaaaattcagcgttctatttcctgcgtaaaaagggacagatcacccagtgtgggttcgagtcccaccgggggcgcggacttctttgccttctttgcaaaaagggacagcaggaagcctatagatgtctccttttacgctaataccgatgccatctcatgcatcttatttctgcataaaaaaggacagatagcgagccaatctgtccccatttacatccaatctccacgcacccattccctatgccctcccatgccccattccctgagtaaaaagggtcattgcgcgcttccatctatctctttttacgctaacatcacccttatttatactaaatttctctcttctctgcccgcccatcttcacatggagattgaggcggatacatctttctgtctattcctatttacgtcgtcttacttttgacattgcacgtgtcgcgtttgcaattgcggtctcagatcggcatgttcggcccttcgcaaacatgtcgtgtttgtaactcgaatctcaacccagccagtaagcgacatctaacatgccatgtttgcagattcgacctcacaccgaccatcgcagcacagattcacgcgccacctttgcacgccgagcctcacccaaaccaccgagcgcgcctcaacgaaccttactgagattcggaatgcaaaacagacaacccaagagacccgcagacgtgccacacttgcaaattcaatctcgcgacgactactacagacagatccgcatgccacacttgcagcgtcaatctcacgacgaccaccatatggaagctacacgtgtcgccattgcaatcccaacctcaccccaaccagcgaagccgccaatggttgccttatgcgatacctcaattcaaatgcgccacgatgaactcaagaagggacgtaaaaagggacagatagacccgctatctgtccccaattacgcagaggaaaacctggtgaagaacctggcgcccagccacgcccagccgcgccaaccgcccgagctcacccgagcagaccggagagtccgccgcccaggttcgacggaacgtcagcgccaccgagcatgtcctgcaaaccggccggcagttcgttggcctgcggtttcttcgcgaacgccgagccgcccgggttcgacttgccggcgagcttggcgcgcaatgccttctcctcggcctcgcgcttcatcgggttgccggacttgccgcccttcttgcctttcttgcctttcttgcctttcttcgagccgccgggaccgccaaatcctccgaatccgcctgccatgccgccgcccatgccggcgcggttggtcatgcgcttcatcatcttcgacgcctgctcgaaccgctgcagcaacgcgttcacggccgagaccgagacgccggaaccgtaggcgatgcgtgcgcggcgcgacccgtcgatgatcttcggattgcggcgttcctcgggcgtcatcgagcggatgatcgcctcggtacggtccacctcgcgctcgtcgaacatctccagttccttgcgatgctgtgccatgccggggatcataccgagcagcgacttcatcgagccgagcttgcgcacctgctgcagctgggcgaggaagtcgtcgagcccgaactcgccttccgccatcttcgcggcggccttgcgggtctcctcctcgtcgaactcgcgctgtgcctgctcgatgagcgtgagaatgtcgcccatgtcgaggattcgcgaggccatgcggtccgggtggaacacctcgaagtccttgagcccctcgccgttcgacgcgaacaggatcggcttgccggtcaccgaggcaaccgagagcgccgcgccgccgcgggtgtcgccgtcgagtttcgacagcacgacgccggtgaagttcacgccctcgtcgaaggcctgcgcagtacgcaccgcgtcctgaccggtcatcgcgtcgatcacgaacagcacttcgttcggctgcacggcgtcgcgaatatcgcgcgcctgctgcatgagcgtctcatcaacacccaaacggccggcggtatcgatgatcaccgtgtcgtacattttctgccgcgcgtattcaatcgagtcgcgcgccaccttcaccgggtcgccggtggtctcgccaggtgccgacaccgcatcgccgcccgcggactgcacgcccttctccggcgcatacacgggcacgccggcgcgctcgcccaccacctcgagctgcgtcaccgcgttcgggcgctgcaaatctgccgccacgagcagcggcgtgtggccggaatccttgagccagtagccgagtttgccggcgagcgtggtcttgccggcgccttgcagaccggcgagcatgatgatcgtcggcggattcttcgcgaagttgagcgggcgatcgactccctgcccgagaatgtcggtgagctcgtcgttgacgatcctcaccacctgctgcgccggattcagcgcttcggaaacctcggtgctcagtgcgcggtcgcgtacgcgcgcggtgaacgagcgcaccacgtcgagcgagacgtcggcgtcgagcaacgcgcggcggatttcgcggattgtaccgtcgatatccgcgtcggaaagcttgcctttgctcttgagatgcttgaatgcattcgagagacgatctgttaacgaactaaatgctgccataatgtccacaattctagcttgcagaggggaaatcgtggagcttggccacacacttgccacgccgctgcgcaaattcgataagctggaatccgggaatacgcacacggtctgcgcgacgggaggaagcatgcatcagaagaagatcgaacagcaggcgctcaaggtgggcatcgtcgtcaatatcgtcatggtgctcgcgggcttcttcgtgttcttcctcaccggactcaagtccatgttcctcgacgcctcgttcacggtgatctcggtaatctcgggcggcgtcgcggcatacctgtcgaagaagacggtgcgcgtgagcgaccgcttcccgaacggcatgttcgcgctcgagccgatctatgcgatctgcaaatcgattttcacgatctgcctgctgctgttctcgttcctcgacgtcgcgcagattgccatcgcctacttcgtgcacggcgagggcgagcgtctcgaattcggcccggtgatcatctaccagattctcgccgtcgccgtctgcatcgcgctcgtcgcgtattaccgcgcacgcaaccgcacgctcggcaacgcgagcctcatgctcaaggcggaggcgaacggcacgtggatcgacggcatgatctcgctcggcatcggcatcgtcgccgtgctgctgtattttctgcccaacggcacgccgctcgacttcctgcattacaccggagatttcttcatcacgacgatcatcgtcgcgctgacgatcaaggaaccggtgaccgtgctgcgcgatgcgtttgtggagctcatcggcggcacgcacgacgacgaggaggtctccgaactcgtctcccgcgaagcgtccgcgcatctgccggccggcgtgaaagtgcagacgatccacgtattcaagacgggcatgaatttcgacatcgacatcattgtcaacggcaccggcgatgtcgtgcgggtcgaggatctcgtcgaggcgcgcaagcggatggagcgcgcgctcgagccgaagctgcacctcgtgaacgtcgatttcgtcttcgactgagacaaccgagactcctccattctccaccccctattccatccccatattccatccccctcgaccccctctacccctctctacccccctctaccccttacaggatgtcaccaactcttacgggatgtctttaacggttacgggatgtcacagcccaaatagacctgcgaggaaatgttcgaaatcatattattaatgttcgtctcagtacggttaacacgccgatttggtaagttttgcgccattgcaaatacatctccaaagaaagaaaacatcccgtagccgttaaagacatcccgtaactgctagaaggcatcccgtaaccgttcaggtgctccgtgagacggaaagcagggaaggatggccggacgcaatcccctctgagcgcgcctttgaggcatctcgcgtacaatatgctcagctgcggggcgtgggcccggcatgcccgagcaacgaggagaacgcatgatcattgcactgtgggtgattctggtactgctgctggtctggatctcgctgagcgagttgcccgccggctgggatggccacgcgccgctgccctacctcatcgcgctctcgccgttcgcgtggatcggcatcaccgccgtcgccatctggtccggctgcctgcgcgaatggccgcttatggcgtgtgcaatcgttggcttgatcgcttcactcctacgcaaaaccgcgtattacatgaatgacctgaagactcccaacaccggcgaactcatcgcccgcaagctcgccgaaaagagggaatcggagaacttaaccatttcatccaactcggctgccgttgaaaatcttgcaaacggccatttcaacgtgttcaccctgaactgcagatacggcgaagccaacgcccatgaaatcgtgaacacggtgcgcacgaacgacatcgccgtgctcgccctgcaggaaatgagccccgacctcgtcaccgagctgcacgatgccggactcgacgatctgctgccattccaccaattcggcgaccccagcagctccgacaacggcggcttcaacggcctgtggctgcgcgtggaaccggccgagcagacgcccactggcgtgccgattcccgccgccgacgtccccacggtcacactgccggtcacgtcgacgttcaacatcacgttcgcgagcgcccacccgaaatcgccgcaacgcagctgcaaggattggtccgccggcatcatcgggcttggcgcgctggcgaaatctgcgaacaaggaccgggaccggaacgcagacgactcgtgcaacaatcgcgaaattgccgtgctcatgggcgatctcaactcgagcatcgtgcacccgagcttccgcgagctgctcgcgagcggcttccacgacgccgccctggtcgaggcgcgcggggaacacccgacctacccgagctggctcaaatggccgcgcattgtgatcgaccacattctgttcaccgatttcatgaccgcctccaacgtgcgcgccgtgttcatagatggcactgaccaccttggtctcaccgccacgctcaccattcgagacacgcgcacgcaggcgaatgccgccgctcgcgaatcctggccgagttcactgccgccgctccccgcgaagtcgcgtcgaaagaccgccgactagctgcccacgcgttcagcgcctcccccttcttgcgtaaaaagagacaaataggcatatccacacgtccctttttacgtctcttattcgcaatcttctgcggaaaaagagacagatggcggcatgcatgcgtctctttttacgcagaggattaacgactcacgattacagcttctggcgcaaccaccggcaccctggcgcaaccaccggcaccctggcgcaaccaccggcaccctggcgcaaccaccgcgctcggcacaacgaacgcttggcacacaggactcaggcgagctgcggacgcagtgtgatggcgaagtcgaattccggcgcatcgaggcggtattgcggcagcagctccggcccgcagctgttcgaaccgatgccggactgcatgtagtccacactcacttcggtgaacccgctcggctgcagctcgaaatcgtgccgtgcgcgcgtcatctcggccgccgtgtattccaacgcctggaaatcgaacccgcgcaacagttccgcgggactctcgggctgcgagccgtcgccctgcacaatcatcaacgccaccccgtcaccctgcactctcgcccagctgcaatcgtggtggttgccgttctcctgcggtttgatctcgcgttcgcccatctggctcactgaagcgctgaagacgccgtgccagctggcgcgccgcttgtccacatagctttcgttcggcccgaggccgcaataggtgacgttgctcatggatttcagcagttgcatgtgaatgccaaatctcggcaggaacgggaacgccggatccttgcgcacgttcatgtgaagcgctacggaaccgtctgcatgcaccgtccacgtggtgtccatgcgggcgatcggctgcaccgtgggcgcgaccgcccccatcgagcacttgatttccaccgcgttcaccgccatcggcccctcggcgtcctccacggccgtctcttcgccgtacgcgccgccgtccacgccgagcgccgcttcgccaatgccgctggagaccacggtgcgcgtctgcacgtcgtacgcgcgcgcatatgcgcggtcgtacccgcagcgctcccactcatgccgcacattgcggtcgttgtcggtgggcgcacgccagatgtcgagggtcatcggcgtcgcgagaatcgtgcggttcgcgtacacgagctcgctgaacaaaccggtgcacttgtcgaacacgtaccgccagttcgcgccgttgatcacaatgcgcgcatcggattcctccaacgtcaccgactcgcctatctcgtcgccggcgagcatgtcttccacctggtgacgcacccactgcgaactgttatctccggtcggattcggcaactccacctcgtcgaagccgagttcgaacagctgctcctgcccccactgcgcctcgcgcgccaagtaccgcagcacgagggtgactcgcccgggctgcgcgaccggccacacgctctcccaaccgcttaagcgcacttcgcccaccgcatgcggctcaatcgcgaacgtgcccggctcgacgaggctgtacgtctgcatcacgccgtccacatacacttcccacatcacgataaccgcttcaccaagctcgcggaagtcgtaatggttccgcagattcaccacgccgcgctcggcatccacgctcaccacgcgcgccggccggaacacgttcttgaactcgtcgaggccgctgtgcggcgtgcggtccggcgaaaccatgccgtccacgcagaaattgccgtcgttcggccattcgccgaagtcgccgccgtacaggtattcctgccgcccgcgcgcgttcctgccggcgtagatcgcgtggtcgcaccattcccatatgtacccgccgagcagcccctcgtgccgctcgatgcactggaagtagtcctcgagatcgcccggcccgttgcccatggcatggcagtactcgcacatgatgtagggcttcacctgcccgttttccgcggtgccgtcctccccattcgcaccgtccccgttcggcccggattcactgaaatacgcgtcgatctcggcgatgctcgggtacatgcggctgtgcacgtctatgttgccgtagtcatgctgaagcgttccgccttcttcgacataccgcgcgctctcgtaatgggtgagccgctgcgaatccagtgttttcacccactcaagcgctttttcgaacccgatgccgtaggcggactcgttgcccatcgaccagaagatcacgcatccacggttcttgtcgcgttccacgaggcgctgaatgcggtcgagaatggccggcacgaaccgcggattgttcgcgatgaggccgttccacatgagctgcgcgcgctgccattcctccatattcgcagattccgcgccgggcttcggcaacacggcgtcggccacaccatgcgcctcgatgtcggcctcgtcgatcacgaggaacccgagctcgtcgaacagatcgtagtaatgcggcgcgttcgggtagtggctggtgcgcacgccgttcacgttgtggctcttcatgagcagcagatcggttcggaactgctccggcgagatcgtataaccggtcaccgggtcgctgtcgtgccggttcatgccgtggatcacaatcggcctgcgattgagcagcacggtctggtggcggccgtcgggcgccacgacggcgatgtcgcgcagcgcaagcggttgcgtgatgctttcgccgtcgctcagaatcatcagcgtgtagcaggtcggcacctccggattccacagcacgggttgttccacggtgagtttcacgcgcgccttcgccgggaatgcgctgccgttctcaaccgcttgccttcggtgggcagactcccccaccgtgcccgtttcagactgaaccgcttccgtcacgccctgcgcaaccacattgcccgccgcgtcgccgatcacgacgtcgatgccctccaccggcacgccgtcgaggaagtcgaagtcgacggtcacgtccgcgctcacggcctgcggcgcggccgccgcacgcgtgccggaatctgcaaaccggatatcggtgcgcacatagaaatcacgaatcgcatgttcggggcgcgtgagcaagtacacatcgcggaagatgccgctcatgcggaacttgtcctgatcctccaggtaactgccgtcgcaccatttgagcacgagcacgacgagcgtgttctcgccgtcgtcaagcgcgtcagtcacctcgaactcgctcgtcgaatgcgagacctgcgaatagcctacgaagtcgccgttgagccacacgtagaagcagctgtccacaccctcgaaattcaggaaggcgcgcgggcaggcgggatccacgtcatagccgaaggtcgtgcggtacaccgcgcacgggttatcgtgcggcacgaacggcgggtcgagcgggaacgggtagcgcgtgttcgtgtactggttgtggtcgtagccgtgcgtctgccacacgctcggcacggcgatctggtcataggagtccgcgtcgaacatcggttcggtgaacaccggctcgtgagcttgagcgcttgcgtccacctccgcgtccaaatcgtagacgctcgcatagtatttgaaatcccactcgccgttgagcagacggaatcgatcggattgctcgcgcgcggcgaaccgcgtatcggtgggcgccgacgccggcacgaaatacgcgcgattcggctcgcaccccacatgcaacgtatcaagatcctcgaaataccgcggaatgaacacggccgtctcctttgcctccaccgctgttatgagaacatggtatggggagcacggtatttccgcgggttacgcccatgtgcagattatctacccccgcacgctatactagtgaagttatttgtgcacggggagccctctcatgccccatgtgcaaggaacacgtgtgtgagcgggtcctgtccccacacgaccggcgaaacacacaccctagttaacaaggagagccactttggcaaccaagattcgtttgaagcgtatgggcaagaagttctatgcggtgtaccgcgtcgtggtcatggattcgcgcacgaagcgcgacggccgcgccatcgaggagatcggcctgtacaacccgaacacgcagccttccaccatcgagatcaagagcgatcgcgcacagtactggctcggcgtcggcgcacagccgaccgaccaggtgcttaacctgctcaagatcaccggcgattggcagaagttcaagggcctcaagggtgccgagggcacgctgaagaccgccgccgccaagccggaagccgccgtgctcgtcgaagaggctgagaacaaggcgcagaagctcaaggccgccaaggccgaagccgccgccaaggcagccgaagccgagaccccggccgaggtccagcacgatgacgagaaggtcgagctcgccgacgtcgaagaatccgcaccggaaagcgtgtgagaccatgcttgctcaagccgtggaacatctgatcaagaacatcgtcgattttcccgacgacgtttcagtcaagtcccatgagaacgcccgcggtgaactgattcgcgtccgcgtgaatccggaggatatcgggcgtgtgatcggtcgcaacggacgcactgcgaacgcggttcgcacggtgatccaggcgatctccgatcacaaggttcgcgtggacatcatggacgtacgcaagtgaacatgcacacgaacagcgtgccagacccgcaacagccccaagagttgttgcgggtctgtcgtattggcaaggctcagggactcaagggcgaggtctccgtggaactgtatacggacgacccgcatgcccgtttcgcacccggcgaggtgctctatgcgcgcgaatccgctgcggacgcactacgcccctacaccgtggccgccgcgcgcacattcaagaaccgttggtatgtgcgcttcgaaggcgtggatgaccgcaatgccgccgaggcgctgcgcaacaccgtgctgtacggcgagccgcaggagctcgatgacgacgagttctacccgaaggatctgctcggcctggaagtgtacctggaatccgaggtgtccgcggcgaatgccgacgacgccccggaaggcgccgaattcgagttcaccgatctcggcaaggtggtcgacgtgatcgagggcgcccaatggctgctcaagatccgcatgccgaaccgcgaggccttcctgctgcccttcgtggaggcgctggttcccgaggtcaatctcgaggagggctacctcaccgtggatccgcccggcggcctcgtccccggcatcggcgagccagacatcgcggacacggcagactcggtcggcgcggcccctccttctgcgtaaaaagagacatttgcaaccgctatccgtccctttttacgtccctattctctgcgtaaaaagggacatctaccagcacctatctgtctccttttacgcagaggggaagcccaccgcatcccgctctcccacccactgcccatttcaaaggagttcgtttggacatcgacatcgtttccgtcttccccgagtatttcgacgtgctcaatctcagtctgctcggcaaagcgcaggagaggggtctgctcgccgtgcgctcgcataatctgcggcagtggacgcacgatgtgcatcagtccgtcgacgacaccccggtgggcggtggcgcgggcatggtgatgaaacccgaggtgtgggcggaatgcctcgacgagctgctcggcatcccggccgacgctcccgcgaacgcgcacgccgccccggccgccgactcccccgtgctgatcttcccgaacccgtccgccccgctgttcacgcagcaggacgcgaccgcgctgtcgcacgccgaacacctcgtgttcggctgcggccgctacgagggctacgacgcgcgcatcccgcagtattatcgcgaacgcggcgtcgacgtgcgcgaatattcgatcggcgactatgtgctcaacggcggcgaggtcgccgtctcggtgatgctcgaggcgatcacgcgcctgctgcccggtttcatgggaaacgccgactcgattgtcgaggaatcatacaccggcgagaacgcactgctcgagcacaatcagtacacgaaaccggcgagctggcgcggaatcgacgtgccgccggtgctcatctccggcgatcacggcagggtgaacagattccgccgcgacgaggccctcgagaaaacgtcccgactgcgccccgacctcattgcgcggctcgactgccacgcgctcgacaagcaggaccgcaagacgctcatgtcgctcggctgggaggtctccggcgagcatccgcgcaaactcgaagactgacgcccacccgcgccctcactgcactctcactgcgcgcggtaggtgtacacggcggtctcgccgtagtcgcgcgcgtcggtgatctgccatccgacgggcgcttcgggtcgctcggtgcgcaccgaccgctcgagcacgatcatgccgtcgcgcgccaccaagccgcgcgcggtgagatcgccgagcagacgttcgcaatcggcagtggagaacgcatacggcgggtcgatgagcaccacgtcgaacggctcgcccaccttcgccttcgccgcgtaccgctcggctttcgcgtgcacgatgcgcgcgttcatcgactcctcccacgcgggattgtgccgcagtgctgtcagcgtatgcgctatgagcttggcagcggggccagatgcctccaccaccaccaattcgttcgcgccacggctcagcgcctcgatgccgagcgcgccggttccgccgaacagatcgagcacgcgcgcacccgagagaatgccggtgctgtcgaggcgcgagaacatggcctccttcgtgcggtcggtggtcggccgcgtctccgagcgcggcgtggtgagcggcacgcccttgaatcgtcctgtaatcacacgcatgtcttcagattatcccgccctctcgccgcaggcgtgcatgcgtgcctcccacgccccttgtacgtcttatttttccaagcattctgcatgatgttctttgcgtgaaaagagacaaattcagcgtccacatgtcccgttttacgcacagcatctgcatccgttgcgtatgtacagctatatctgatctgtctgtatctgcgtaaaaagggacagatcggccaccaaagatgtccccaattacgcacgagctgaatctgcgaactgcgtcgaactacatcgaactgcgccgaactgcactagttgctggtgaggaacctctcgttgccgcgcgagaaatcgagcaccgcgcccgcgaattgcgcatggtgatcgagcatcggatcggcgtccagcagcagctcgtcccacgacgtcgcgagcatcaagctgtgcatgccgctacgagccacaaccaccaagcaacctgaacgccatagcgccaccagcaatgcgaagcacgcccttgtacctgaacctgcacgcgcaaccatgccgaaccagcttggcaaaccgatagaccccacagacagcccaaaaacactgaggcccgcaacgaatggcgttgcgggcctcagtgttggctcggactagctattcccggtcagcagctcactcgttgcggcgacgggcaatcagcaaaccggctcctgccaagatgagcgcggccgctgcagccacggcgagagcgatgtccgcaccggtgtcggccacctgttgcacttccttcgccggttccttggcttccggcttggccccaggcttagccggctgggccggttcggcaggcttgctcggctcaacgggcttggtgtagacgttatggaacacaatgccttccacgccttctggatactcgaccgcggccacgaggctgcccttgaggtcatcagtcactcgcacggtcacgtcgtactcgtggtcgtcgtaggtgatggtcttgtcatcgcccttgacctcgtttaccacatagtggtattccccagccttctcgtagccaatggtgccgaacaaggcgctaccggttgcgtcattggtcaccgtctgcacaccgtcaactgccgcaagcggcatcggggtggattcatcggctccacgcagactgaacctgaactcgccttcacgcggagcgcgaccgtcgagcaacttgcccacgccgaactgaacggcagttggaactgcggcgtacgtgttctcgaaagccattgccttcacggcgttgccatcggaatcggcaatctgccactgcactgcaagggttccgtcacctttgtcggtaacttgagcgaccaccgcataggtgcggttgtcataggtcacgccgttgtcggcgtcagcggcgttctcgcggaccaggtaggcgtagttgccaggggcgtcgaacgtgactgccggcagcttcacagagccgtctgccgcgttcttcgcggtgccaacaagcgtgccgtccgccttggtgagggcgaattcgaactcgccgtccttcaagtcacgaccggcgatggtcttcgtcatcggcacgccaccggtcacgacaccttccctgtccgggtcggtcggcgacaccgggtcggtcggcgacacggcgtagatgttggtgaacgtgaagggcatgccttcgctgtcctccacggcgagggtgccatctccgttgtccctgactttcacgttgaaggtcttggcactgtcgttggtcacgcctggcacattgccttcctctgtgacggtgtatgtgaacgtcttctcacgcaccttgtcggttccgaatacgttctccatggtgtattcgatgtcaccaaagttgacgttgccggcttcgtcgttcgtggtctgcatgttcttcggcattggtgcgccttccgaaccgctgattgtgaacgtgtacttgcctgcaatctccggagcgttgtcgccagacttcacgtcgagcttcttggctccgatgatcggcttgctgagcttcgaagaggcgccgtactggttggagaaaccaagacggtcggttccggccgggtactctacgcgggcactgagagtgccgttgccttcgtcggtgacgatcagtttgatgctgaactcgccattcagcacggtcacgccgctcgtcgggtcgggctcgtcctccgtgacggtggcttcgtagctgtacgtagtcaccggcggcgtcttcgtgtaatcgacattgcgaatggcgatgccgttctgcacgtcgttggcaaggcgctcggcagtgaactcgattggagtgaagtccacattcccgttcgcatcgttagaggcggtggcgatcacgttgcccttggcgtcgcgcacggcgaagtggaattcgccgtcggcaaggtcgcgtccgtgcagcgtcttgtgtgcgttgatgcgcaccggcgcttcaccgccaatcgttaccggcgccgtcgcgtacacgttgtggaacggcagcaccggcgtcttctcgctggtttcagtgccattgacactcgtgtgcacgcgcattgtgccgtcgccgttgtcggtggcccagatctgcacggcgtagacctgctcgtccacggtcagtccgttgccggactgcgcgccaatctggtcgacctcgaagttgaacttcctgcccgaacgaacgtcgtcgtgcgtgagttcgagtccggtgaacagccccggcacggtgacagtctcgccgctggccgccgcgtcgaattcgtagacgcccgacaccgcgcgtgcccgtgccgtgtatccggcgcgctgcatgtcttcgtcgctgccgcgcaccacgaactggaattcaccctgtgcctgcgcacgtccggtgagctcctcggtcacgtcgacgcccggatacgccacgttctgcgtggtgtacttgttcgtgaacaggccgttctccacggtggtggcggtgacgagatggccttgcccgtcgtctgccacctccacggtgatcgtcgcggtgtgcccgtcgtacgccatacccggctggttgccggcgatttcggtgacggtgtaacggtagacgcccgaacgtgtgtacacgatctctccgaagtcgaagctcgcggtgtcgccgtcggtcggcttgccaacggtgacggtggcgttcttcggcatcggggcgccgtcctggccctggatcgtgaactcgaactgctggttctcgttccatgccatgccgtcgacgcgcttgtgcagcgtgaagtcggtgggcacaccggtcgccggctgcgcagagtacttgttcacgaactgagattcgctcaccttggcttctgcttgcagattgcctctgccattgtcggtcacggtgacggtgatcttcgccgtgtggccgtcgtaggcgacgccgggcatgtcgcccttcgtctccttgaccgtgtactcgtacgtgcccaccttgtcataggtgatatcgccgaatatgacgtccgccgtatcaccttcggcaggcttgtgcaccgccttcgtcagcacgccatccttcgcgccttccggcatcggagcgccgtccttgccggtcagcgtgaactcgaacgtgcggtccttcggccacgcaatgcccgtcaattgcttcgacagcttcagatcggtcgaaccgaccgtcacctgattcgccttgtatgtgttgacgaatgcggcatcggtcacttcggccttcgcttcgagctgtcccttgccgttgtcggtcactgtcacggtcaccgtcgctgggtgctcgtcgtaggtgactccgggcatatcgcccttcgtctccttcacctcgtactcatacttaccggcggactcgtacttgatgttgccgaagtcgaaggtctgggtatcaccggaatccggcttgccgacggtcttcgtcaacacgccatccttcgcgccatccggcatcggagcgccgtccttgccggtcagcgtgaactcgaactcgcgatcagctgtccattcgacgcccgtcagctgcttcgagaattccataccgtctggcacgccgtcgaacgactgagcctcgtaggcattcgtgaaggtgttcgactcgccgatgccggtgataagcggtttgccggcgacataccggccgaggccgttgtcgacgacggtgaacgaggcgatcgccgtacgtccgtcatgcgtcatgccgtccgtcgttgtgccggcgttccgttcgcgcacattgtacacataggtgccggcctgactgaaggtgaagtcgtcgaagtggaactgggcggtgttgccgttctccggcttgcccaccgtcaccgacttccgttcgggcatcgccttcgtcaacacgtcctccggcacattggactggtccggattcgccgtcagatcgaaggtgaacgattcgccgtccttccagtcacgaccggtcaccgtcttcgcgagcttgaacgactgactgcctgccgcggctgcgtactcgttcgtgaagtgcgcgatagcgtcagtggagccatccacagtcgtttcggtactcatcgtaccgtcaccgttgttgtcgatgaccttgatgctgaccttatgcgcggcgaagtcgtaggtcacgccgttcttcgtcggcgattcctgtgtcacgtcttccggcggcacttcgcggactgtgtactcgtaggtcttgcctgcgtcgtcttgcgtgaaccgcagtccggcgagcagtgtgccattcgccggccagacgagctcctgcccgctgactgcggagaacgggttggtcgtcgtcgcatgcgccgcaccgcctggcatcggggcgccattctgtggctcgatgatgaacccgaactcgccggcgttcatcgaacgtccggtgagcgtcttgccaatgcggaatccgtcggcagtgccttcggcaccgtaatccaccgatgcggcgtacgcgttcgtgaacaggtcgttgccgtcagtgttgcgcctggcttcgagttggccgttattgtcggtcacctcgtacgtcacggtatgcgtgtgcgtgtcgtaggtccagccggcaggcaccgggttcgggatctgctcggagatgccgaacgtataggttcccggcttcgtgaatacaatgccttcgaagttgatgtcggtggtgttgccgttcttgatctcgggcgtcttcaccgtcatggtgtcccaattggtgagggtgtcgttgttattgatcttgacattattggcatcacccgaatcgagcttggcctcgaaggtgaacttacgggcttcggcatcgcgtccggtgactttcttttccacctgcaacgtctgaggctgcgttggcgttgccttatacgtgttcgtgaactcgatgcgcttcgcgccgttcgggtacccaaccgtggtgatgagatcctggtttgaatcgcggctcaccgtgatcgtcacatcatacgtgttgaggtcatacgtcatgccattgagcgtcgggcttgcacctgtcggcacatcctcgcgcacatggtacgtgaaggtctggctggtctggccgttgagtgcggcattcgtgaatgtcgggttccagctccaagtgccatctgctttcacgtcgacgggctgggtgggaacggctggaccattgtccgggttattaccagcagtaataatcaccttgaacttgccgtcctcattcggattgcctcccgtttggtcggtgtagttcttgtagccgttaacaattggtgcggactcgttcttgccgaggaacctgttcgtgaacctggcgtaatccgtaggctctgccgggttgactgcttcatactggtcgttgtaggtcttcttcatgttgaccgaagcggtcattgtgccattaccgttgtcctcgacggtcacggtggcggtgtagcttgcaccggagtactgcatgcctgccttgtcacccggattctcgcttatcacatattggtatgtaccgggattggaatactcaatcccaccaaacgagaacgggtatggttggccggccttatagctgccattgttcttcaccgacacggttgctgggttgggcagaggattcttcgaattctccccaagcggcgaaatggtgaacgtgaattcctcacccggctgccaatcgcgattggcaagcactttctcacccttgattgaaccagttgcaagcgtcgtcggcgtgagcgcataggtgttcacgaagtccagattggtcgtcttgttcttttcgatcgtgccggaatcattggcatgattgacactccagcctgctccgccatggttggtttgctccaccgtggctttgagccccggcgtcagaccatacacggtgacgctttcgccgtccttgagctcgaacgtctgtccattcgtcacggtcatgccttccccggcaatgacggcctggaattcgccatccgcacccgtgccttcgagctgcagtgtgaacgggaacgatttgttcgggtcacgctttgcgccctgcggccacacaaccttctccgtcacatgcagcgtgccaactccggcaagcgtctgcttgccgttgttgccgaggcgcacggtgacattgttcatctgccattccggcgcgatcgcattcgacgcggtgttggtcgtgttcggtttcttcggagccgtgtatagacgcgacagtccggtacgctcggtgcctgcgggagcatagtaattccccttgctatccgcaaccgccttgccgtacgcgttgctgccgagcacgtcgatccactgctcgtgcttcgcattgttcgcgtagtacgtgcgctggtagtagtaggtcttcgtcacgctgttttcgatggacttcgccgggtcttccagattcttggaattgtacagcggcgtgtcctgcgtgaagtagtagaagtcgttcgtcgtcgccggcgtgaacacggcggtcgtcgtaccgttcgccgccgccggttgtgccgacgtgtcgtaggcgttcgtcaggaagtacacatcgccgctcgcgtcggtatgctgtgcgatgtactgactcatcgccgcatccggcttggccaccttgtctcgcacaccgtctttcagcgcaacgtcgtagaacaggcggatcgggtgcgtgcgtgcgatgctcgtcgtcacgttgccgtctttgtccaccttcgccgtgtacaggcgcagcggtagcagatccgccggcacttccaccctcacggtgtcgccggtcttctcgccgttgtcggtgacggtgatcttcaggtcctgcagattcgcggccttgtagacctcattgccggcgacttcgccgtggaacgtgtaggtggtcgtgttgccgttcttgaccaccgcgttctcggcgtcgggatcgaacgcgaacttcgttcctgcgaagatcacgctgttcatcgatgtgacggtcatatagtcgccgagctgatcggtgaacgtcaccgcacctttccgctcaccggtcgtgccatcttgcgattcggcctggatcggtgaggtcgggttgctcgagacctcgctccagattgtgttgaacacggcattgagcgtatcggcgtcggatgcggcaaggtagtagtttgaattcggggctttggcacccagattggtataggtggtggcgttcgggtagttgctggagacgccctgcatgaacgcattcgacttgagctcaatatcgctcttgccggtcacactcgacacattggcatccggattagcgcccgtgaagatgcctaccgaataaaccgatgcgccattggtcttcatcgttttcgctgcgccgatggcatcgttggccacgtcgttctcaaaaccatttgatttggtgggctggccatcggtgaagaaaatgacgatcttcgaggcatcggcacgcgcattgccaagaacggtgttagccgtctgcatgcccagatccgctcgtgtggcgccggatgccttcaggtcgtccacggtagacttcaggccactcagggaatcggtcaggccgcttcgcgtatttacgtcactcgcgtaggtgacgagaccgatgcggttcttcttgttcgggtcgctcaccttggcgttcgccgcaatcgtctggtcgataaagccattcaccgcctgcttgagcgcatacatgcgcgtgtcttgagtcgtcagcctccgccggctgtagaactgcgtatgcgcggcgtcactgtcggcggcggatgttttcggagtcacataatgcctgctgcctcctgcgtcgtagtaccagccgtttgctgaactataaacgcgtgtcattgatccactgacacgaacgtagtaccgtttgctggtggtgatgtcggccgcatatacggggtcatatgcatactcatcatcgccatccatgccccatgccatcgaccccgaggtgtcgagcacgagcacgatatccaacggtttcgtcacattcgagacgccgatgagcttctgcgcgctcgacatcgccgaaagaccgacaaggaacgaaccgtcctttggtgcgacagtcacgtgattgtcgtcatatgtcttcagcgtcacctcttgggtagacaccgacttgtcggtccacacgcgtccggtggagcgtgggtcggtcggctcgccgatgccctgctcccactgggtgaacgtcgtcgggtcggcgatcatgtttcccgccgcctgcgccgggatcgccaccaacgccacggtcactatcatcgccgcgctgatcacgccggcgatggccttcttcgtatttgcgcttatggagccgaagagtcgcttcccccactcgcgcaactgccgtatgtccattgcaatgcctttcttctcgcatctccctgagaagaaaagcactaatatgagcccctccccgcagagatctggcagtcaagaattcgcccgaagcaaacaatccctgcgtcaccaacgatttcctgacttatatataaatatacatgctatcagcgaaacgtatacaaatcaccgacatctcatttctgtgtccacattttcccatcgccccaccaaatctccccaccttcttcgcatctccacccctcactcgcagatgacgaaacccatccccccaactttcgtcatctgccgcgtgccttctggcaatcgacgaaagatcgtcaatctttggtcgattcctatacacgcgcacaacaaaacgaccatatcccaccatcctgcgtaaaaagagtcatcaaattgcccataactgtccccaattacgcacgagctgaatctgcgaactgcgtcgaactacatcgaactgcgccgaactgcactagttgctggtgaggaacttctcgttgccgcgcgagaaatcgagcaccgcgcccgcgagctgcgtatggtgctcgagcgtcgggtcggcatccagcaacagctcggcccgcttgcgcgcatcggtgatcatggcggcatccttgaccacgcgcagcagtttcaggctcgagcggccgcccgactgtgtatcgccgagcacatcgccggcaccgcgcaattcgaggtctttttgcgcaatcaacgcgccgtcgagcgaatgcgcgatcacgtcgagccgctgctcggcaatgctgttcggctcagcctgcgacaccaggaacgcccagctgtgcgtgccgccacggccaacgcgcccgcgcagctgatgcagctgggagagcccgtacctgtcggcgtcgaagatcacgatgcagctcgcctgtggcacgtccacgcccacctcgattactgtggtcgccaccatgaccggcgtctgcccgctggcgaattcggccatcacgcgctccttcgtctcgtcgtcgtcgcggccggtcagttcgcagaatcgcacgccttggaactgtggcagcgattgcaggcgctcggagatctcatgcactgaatgtagcggcgcacgtgcgttcgtctcgccgaggtcctcgtcgctgagcagcatgccgtcgtcggaatcggcgcgcgcatcgccgccgctttccccgccctcggcgtcttcagtcgactcctcgatgcgcgggcacacaatgtatgcgcgctcgccggcgtctatgcggtggcgaatatgccagaacatctcggccatgagcggcgcgttctcttcgggaatcaccacggtctggatcggcttgcgcccgcccggcaactcggtgagccaggagatgtcgaggtcgccgaaccaggtcatcgccgccgtgcgcggaatcggcgtcgccgtcatcaccagcagatgcgggtccacgtccgacttcgaacgcagtgtttcacgctgttccacgccgaagcggtgctgctcgtcgatcaccgcgagcgcgaggttcggtgcctggaacgacttcgagaacgcggcgtgcgtggccacgacgatgcacggctccccgcttgccgccgtgccgagcactttgcgtcgctcggcgagcttcatgccgccggtgagcagcagcacgggcgcgcggttgaacacgttcgagatcgattggtaatgctgctcggcgagcacctgcgtgggcgcgacgagcacggcctggtgcccagatccgaccgcctgcagcatcgcgctcaccgccaccaccgtcttgcccgagcccacttcgccttgcagcaggcgctgcatcgggtggtcctggcacatgtcgtggctgatctcgtcgacgacctcccgctggcctttcgtcagtacgaacggcagcgtgtctatgtattcgtcgcgcagttgcacgtcggagcacacgtacgcgttgtgctcgcgcgcatcgtgccgggcgcggatcagcgcggtctggcatacgaacgcctcctcgtagcgcattgtcgtgatcgcctgcgtgaacgcgcccaccgagtccgggtcgtgaatctgcgagaatgcctgcgcgcggtgcatcagattcagctcggccagcagattccccggcagaatgtccgggatcgcggcatccaaatgctcgcgaatctgcggattttccgcatacagcgtgcgcatgtgcggctgcgcggtctcgtcgtcggcgtgcatcgcggtcgccgggtcctcgccggcgagcagacgcaacacatagaggatcgtgtcgtgaatatgctcgctcgagatgcgcgaattcgcatggtagacgggccgcggccggcagacgcgctgcagaccctcggccaccgtgctcacatcggcccgcagattcgcgccgcccacggtgagcagttcggggtgggtgaattgcagacggtccatatacatggtcggatccccggcaatcaccacgtggccgtcgacgcgcaagcggccggcgagccagtccacgtacgatttgcgatgcgagaagaacacgagcgtggccagcgaaccgcgcacatggagcgtcgcggcgaactcgtcgtcgtcgacgagcacttccacacggtagccggcgcgcgcgttcatcgggctgacacgcacgctgcgcacgcgcacggcgcacgccatcttctccttgagaccgggctgggcctgcacgagcgcgcgcacggggacgggatcggtgacgcggaacgggtaatacgtgagcgcgtcgcgcacgtcgagcacgccgagcttcttcagtgcgctcacgcgacgtttgttggcgagcagagcgtgcagcggcgtctcgagcgtcacgtcgcgcgtaccgtcctgccgtgccattgccgcctccttgttgtcatagtctatcccacgcccgcagattgcgaaacccgcgccccttccctgcgtaaaaagagacatattaggtgcgctaaacgtccccaattacgtcctatttttgcgtaaaaagagacatctaagcgcccctgcctgtccctttttacgcagagaaaggagcgcacatacgaaaaggccccgggagccgaactcaccggggtcttgtcactgtatcgcttacgctcacgcaaccttcactcgctgaaccttgccagccttgaggcatttcgtgcacacacgcaggcgcacattctggccgtcgacggtggtacgcaccggctggaggttcgggaggaagcggcgcttattgcgaatatgcgagtgcgaaacggtataaccggtctgcggtcccttgccgcacactgcacaacgagctgccataatggactccctatattactattgacttgcaagtctgcatgcccgtatgctccgcatacacgaagcacagtcgaacacgcaacttcacaatattacatgaaccgtgccgacaacgcaagcccatgattctctttgtgcaccacactgcgcacagaccgggcatttcaccgcggtctgccgcgttttcagcgagttctcagattgtcgggtagaatcgcgcataacgagatctgcgaagcggcagaatcaagaaaaggggtgctatgctgagcgatattcttcactcgatccaggcgaaacgcgaccacgagcccaccgtgatctcacttgggcaggtgtgggtggattccatgatcaaggttcccgagttcccggcaccgggctcgttcatgaacgcggagagcatcgcgagatcggtgaacggcagtttcgcggtgctcgaggcggcgagccgcatgggcgcgcagaccgagctcgcgggcatcctcggaaccggcccgtggtccgacatgatccgtcgcgcattgaaacgcgtgaatgtgaggcataccggcatcacgaacaaggggctcgacaatggcctgcggctggtgatcaacgacggacaggaacgctcgttcatctctgctcccggcgcggaggtgcgcaccgacgcgcacacgttcgacgacatgcaccccaagtccggcgacgtcgtgcacatcagcggcgcatcgttgatgaacacgggcgcggtggcggtgggatcgttcatctcacggcctgaatgcgcgccggatgtgcgcgacttccgcattgtgctcacgcccacgagcatgatgtccacggtgaacgagcgtctgcttgaagacatcgtgctgctgcacccgatctgggtgctcaatcggcagcaggggcgcgcgattgcagaccggctcggcatcgaggtggatgagacggccaccatgcgcgtcgacggcggcttcgacgattcgatgagcgcgctgtgcgacgggcttgccgatgtcttgcgcgcgcccgttgtgctgcgtgccggttcgcgcggcgcgtgggtgcgtcggcatggcgaaccggtgcagcacatcgacggattcgagacgaaggccacgcatattcgctcggccggccccacgcacaccggtgcgctgtgcgcgctgctggcgaatgggtggaatctggaaagcgccgtgcagattgccaacgccgccgcgtcgatcgcaatcacgaagggcatcaacggcgtgccgcaatgccccacctacgacgaggcggtcgccttggtcacgaaggcgctcaaagacgccgagcacgccgactgacgccggtcagcgcgcgcagccggcgccttcctgcagtgcgcggcacatccacagcagcgtcggttccgcggaatactcggcgagaatctccacaccgtcgtaggcggcgagcggaacgccggcatcggcgagcagcatggccgcccgcgtgagcgtctggattaccggctgggtcggcgagatcgggattccggccgcctgcaatgagccgagcgcgtgcccgcgtgacggtgcggtgggccgcgcgtccaccgtcgcggtgaaactgcgctcgtcccgctcgccgtcgtcgtccgcggagccaatctgcgcgagcaacgcctccatcgcctggcgcgcgacgccggtgtacgcggtctgcgcggccacggtggacgccacatagtacgcgtcgatcgccgtgtcggtctcgcccgccatcgcgaacatctgcccgagcaggcagtacaggaacgccacctcgtcgggcaccacggcgagcttgagggcctgccggatggcgtccaccgcgcgggccgtgtcgccggccatcgaatacgccatggcctcggcgatgccgccctgcacgctggtgggcgagatgcgctgcagttcctgcagttcgcgcagtgcgtcatccagttgaccaagcttcatgtcaaagcgcgcgagctcggagcgcactgcggcgattgcacccggcaccgtgcggtaccgcgtcgccgcatcacccgccgcctcggagaccagcaatcgcaacgcctcccgctcgcagtacagcggctggcgaatggacgtgctcaccgaaagctcctgtttgagcgtcgtgagcgccccgccgagctcgaccacggcggtgaccggcgaatccgcgttctcctgggcgatctggtgaatgtcgcgaatgctcaggctcgcctgatctgcaatgtccagatcgcacacgcggtcggcgcgcagcaggctcttcagcgaatccggcaactcgcgcgcgtcctcgccgagtggcgtgcgcagttcacacagcgactccggcagctcgggatcctccgtcggcgcgaaccatccgtcggcgtcgaactccacacgcgcgctgtccacgtcgaacgcggcgagcagctgcgcggggtcgacgtcgaactgggcgtcatcaatcgtgccgtccgcaaacagcttggccgtggtgaaatggaagtcgacgcggttgaacccgagcgagaacagcgtctggccatccggttcgccggcgcgcgcgatcaccgtgacaccaatgattcccgtgttcaccgcgaatccgatgttcgcgagcaatgccgccaagcgcaacgcatatgccgccgtccactgcgcccgcttgccggtgcagtcgcgcgcgcgaccgtgcgaatccggcaccgcggtggggaactgcgtcggctcgggcgcgccgaatgccactgccatgtcgccggtcgccgggttcacctcgacgctcgtgctcacgtggaacggcaattgcaaccgttcgcagattgtgtggaaccgcgtcatcacatcccacacgccgcccggctgcgcttcgacgccgtagattgtgcggaacggattcggcgcgccctccgccctgcctacgaactgcgcgtgctgcgaccacagatgcgtcgcctcaatgaaatcgagcgcactctcttgttctgccatatcccctactcctgctttgcattgcttcactgacacgcagtatacgcaccactcgccccgcggcatacatctccgtgcccgcatttgcagatttcccaccccgcagcctccccctgtttctcacctcccagcctctccttcttcttctgcttctccttctgcgtaaaaagagacagaaccaaccctccaaccgtcccgaattacgcagactcgaatatgcgcgccgccactctgcgtatctgcgtaaaaagagacagaaatagccgtccaactgtcccaaattacgcagattgtctccacaattactcagcacaccgacggcggcatgtgcgcacgaatgcgcacgctcacggatatggaacaatccggcatgcgccgtgccgaacatgctacgattccaccagatcacgcgatatatcgcacagacgacggaaaccgaatccgaaaacgcagcacatcacgcgatgccgacgctgatgccggaggacacgaggaacatgcaggaaccattgggcaacccgtaccagaatcccgagagcacacaaagcgcgcagagcgccgccggccttggaaccgatccattctcgccggtcaccccagtctccgtcggcggccaagggcaatccgctcccacgaaccagtcagtgcaaacctaccagctccccttcctggcgaaggtttccaggctcgcgcccatcccgggcgaccccacgaattcgcgctatggcatcgtcatgcggctcaaagacgtctcgcagccacagaacggactcggctacatcgtgcgtttcgccgacgatcccgccaccggcaagcagaacaacaaacaggtgcagatcatcgcctggatctccaagagcctcaaggtctacccgaccaccgtgccgctcaccaacgacccgagcaccaacgacgtcgaaggcgaactccatttcgacgcctggaccgaccagaagaacctcggcgccgtgcgcatccagtcgaacgacggtctgaaccgcaccatcacgatcggcgagctccagctcgacttctcgggtagcggctattccaccggctcgctcaacggcatcgccaccgcctcctctgtcgatctcggcccgtacggccccgccgcaaccaactcagccgccccagcacacgcaaccaacaccggctccgccaggcacccgctcaattcgctgctcgccgcattctggctcgccgctgcccacttcccgaagctgcgcggcgaacagctgggcatgggcgccggccgcatcgttgaaatcttccaaaatatgcagaacaagccgctcgccgacgcgctcgacgagatcatctggcgcggcaccacgaattcgaacaccgcgagcccgttcgagcggttcgccgcacgccagctcatcgaggcgggagccggccagattcgcgaaatcaccgccgagcacaatctcgacgtcgtgcaactcgacagcaccggccagttctggatgcgtttcaaccgcaacgagatcaccggtctgcagcgtgacatcgtgctctcggtggagggcgcgctgaatcgtctcgccgccgccagccgtatcgccgccaagtatgacaacggcatgggcttggtcaccacgcttaccgaggcgcaggattaccgcgccggcttcgacgagttgcatgagtgggacacgcacacctcgttcatccagtcgcgcgccgacgcccgcaattcgaatctcaccgtgcgtggcgccacggccgcacgcggtggcatgtgggacgtcatgtcgcggttcgtagacatctgcgaacgcctcattctgccgtaccgcgtggagtaccgctgcgatgcgaatcccgacaccggcgagatggtcgtcaatttcacggttcccacgtcgctgatgatgcccgccagcgtgctcaccgactccggctgggtcggcattcgcgagcagcgcgccgcccaggccgcctcctacgcgctgcggctcgccggcatcatcgcgcaggccgcgttcaccgcgggcacgaacatcacgtcgctcacggtgaacggcacgctcggatcggtcaccggcgcgcccgtgctctcgctcgcgttcacacgcacgccgttcatgatgggcacggtgcccgcgttcatggccggccagttcaacgatcccgcgctcgacagcgacccggctgccgtgctgcagatgctgcgcccttccgcacaggtcatctcctttggcccggaccgcggactcacgccgatcaccgcgctgccgatcccacaggcgatcctcgcgcatcgtgtgccgctgtggcgcgatgaccgcgagctgcccgacgatctgaaggcgctgctgggcgccgatttcggccgcgacctcgatgtgatgtacgacggcgcgagcatcaagggcggtgagattttccagattgccgagcagaacgaggactctcccatgtccgcctcgctggagattgaatccgcgctgatgggactgcaaagcgagatgcccgatctcggcgagcgcaagccgctgtactgcgagcatccgctcatgcgcctgctcgtcgcgaatctgcccgaccacacgccgcagacccgctacgtcaaggctcccgacgcgctgtacaactcgcatatcgcgctggctcgcatccaccgtgattccggcgacctcgacggttcgctcgcccagctgcagcaggcgctcgcgctcgcgcccaccaccgcgcagccgttcgtcgacgagtcgatcacctatgtggacatcgccggcgaccatgcgaagggcgcggacgtgctcacccgcggtcttgcggtggcggtgatgccgggcgacgtgaacttcatgtattaccgtcttgcctattcgctgtggcagaccaacaatcgcgaggcggcgctcgcctgctacgcgttcatgttgggcatggggttccacgcgcagtatgaggaggctgccgaggtcgaggtgcgtgagctcatgcaggagatgggcgtggattcgctgccggatatggatgcggtgacgcacacgctcaacaagcatggcattccggtggcgccgctgacctcacagactgagctgctcgccaaggcggcgatcagactcgtcgacgccggcttcccgctcgccgccgacgaggcggtgtgggcgcttggcgcgttgagcaacgacgaccgactgggtgcactgcgccagagcttgcgtttcggtgtgctcgacgaggatgccgtgctcgcctccgagcgtcccgccaactgatccccaatctgcgccccttcctgcgtaaaaagggacatccgcgcgtcccaaatgatcctttttacgcaaatgaaacacatggatcacagcgagccaatgccctgcacgcatcccccggcgtagccctgcgtaaaaagggacatcttcaccccctaatctgtcccaaattacgcagcggagtggtaggcagcggagaggttacgcagcgagattcgcaagatccgggagatccgcgagatccacgagatccgcgctcactcgcgctcgccgtacacctccgtcacgaattgccgcaggcgcacgatcgcctttctcagatgctcggtctccacgcagtacgagaggcgcagatagcccggcatgccgaacgagtccgacggcaccatgaacaggtcgtattccatcgccttgcgtgcgaactcgttcgcatcctcctcgagcgccttcgggaatatgtagaacgtgccgctcggccgcaccacttcgaatccgaggtcgacgagcgcgtcgtacagcagattcatattcgcttcgtaaatggagaggtcgctggtgtcgtcgatcacacgctccaccgcgagctgcatcgtggagctcgggcagttgtgtccgatcgtgcggctgatctgcgcgaacatcggcacgagcacgtccgcgtccgtcgcacgcgggttcaccgccacgtagccgatgcgctcgcccggcagcgagagtgatttcgagaacgagtagcaggtgagcgtattgtcgtagaacttcgccgggtatgcctgcgcagcaccgtcgaacatgatctcgcggtatggctcgtcgctcacgatgaagatgtcgtggccgtattcggtctgcttgtcgcgcagaatgccggccagacgctccagcgtggccgccgagtacgccgcgcccgacggattgttcggcgtgttgataagcacgaccgccacgttcgggttgagcgcacgctcgaatgcctcgaaatcaatctggaatgcagtggtgtcgggcggcaccacggtgagtgtggcgcccgtgccctccacgtacgggatgtattcggggaagaacggcgcgaacgtgagcacttcgtcgcccggcttggtcaccgcgcggaatgcgtgcgcgagcgagccggtggcgcccgacgtggggaagatgtgctgctcggtgtagtccatgccgaagcggcggttgagcgagtccgccacggcgccgcggaacgatgtgatgcccaccgacgggctatagccgtgcagcgcgctcggcgcctcgttctcgtacaggtcgatcaccgcgttcgtgaacgccggcgtgcacggtacgctcgggttgccgattgagaagtcgaacacctcgtcggcgccgatctccgcgcgccgcgccgccgcccgctccgagatcatgcggatcaccgacttctcacccaacattgccttgtacttctcgttgatcatgccaagcctttcgctatgccgtagattatccgtagattcccagacccatcctatgcccccacgtcacgcgttatgtttcctgccgtatttcgcaagttgcgcgcggatttcgccgatcaccgacctgccgtgctccggtttcatctctgggtaggcgtcgaggagcctgcgctgctgccagttgaaggtgccgtgcagtttctcggcgagctcgccgtcgcgcatccgctcgcgcgcgccgtccacatgcacgcccacatgctcgtatacagattccttcacacggctcgccacgccttccgcatgctgctcgatctgttcgatgcgctcgtctgcggccgtgatatgcacgtccattttggcaatctgctctttcttcacagatttgatatattcctcggcacgcccgagtttgccgttcatgctgatcaggccggcgagggtcacggcgacgtccgccatgaggatcacgaacagcgtgatgctcacgatgttgagccagagcgggtcgaggcggtcgagcatgcgcatgacggcgggctgcacccattccttcaccacggtgcagcccgcggcgaagaacaggaagccgttcaaatagacacggccgttgatgttgaacggcttgttcgaatagtcccacagccgcatgtggaagagtttctctatgccccatgaggtgatgtattccaacgtgcaggcgagcacgccgctgctcaggaacacggcgatgagcgaatgctcgtcgtgcagcacgaagatcgcgagcgccgcgccgaaaccgtagatcgggcagatcgggccattcaatatgccccggtccacgaaccgtctcttcatcacgatgttgagcccggtctcccacacccatccgacgaaactgtagaggaggaaccatacaaacgttttttccactgctgcaagccacataccttcactgtctcatacgccccgtatgtcgtgctcccatacccggttgcgctggcaacgatacggccggacttattcatcgcctactatggaagtgatcaatcggagggcaatatggcaacgatcatcgactacgtggcgcaggagacgcgcgacttctcggaatacccgttccatgttgccgacgcgctggtctacgcgattctgagctatgacaagatcccgcaggaggtcccgcagctctcctccctgctcgaatgcttcggttccatctccagcaagctgcgcaacttcaatctcaaacaccctagccgttcgctcgccgcactgtggcgcacgccattcccgggacccacgctgcgcgaggtggaggaaagactgcacgaatacgagctcacccacccctattgggagcatcattccggcttctccgacgacgatgagaccccgcaccgcttctaccgctcgatcaaacgcaatccgcggttcgccgtcacccgcatgagcgccgccgaggagcgtttcgacatctcgcagcagacccagtacgccgccgagacgttccagctgcccgacggcacgctgctcgtcgcgttccgcggcaccgatgattcgctcaccggctggcgcgaggatttcaacatggcgttcacctacccggtgcccgcgcaaaagcaggccgccgactatctcgaaaaggtgggcagactctggccgaacgcgcgcatcatgctcaccggccactccaagggcggcaatatcgcgatctacgcggccatgaacgcgcgcgaccagatcaaagaccgcatcgaacgcatctacgctttcgattcacccggattcaaccaggacgtcgtctccagttacgaatacggcacgatcgtcgaccgcatcaccaagctcgtcccggagttctccatcatcggcatgctgttgcagtcgagtccgcgcgaacatatgatcgtcgtcaaatcgaacgccgacggcctcatgcagcattcctgctacacgtggcttatggacggcgaccgcttcgacacggttcccgcgctgtccgagagctcgcgagatttccgcggcgcgttgaacacctggctgaacggcatgacgcaacgccaacgcgagcatggcgtggaggcgctgttccgcgtgctctcctccggcggacactccaccatcacccagctgcgcacggatggcatgaaagcgcttccggggctgttctcctcctatgtcgggctcgacagtgaggaccgccattacataaatcaggccattatgctcctggccgggacgcgtttcacgcactgacttcgaccaaacgtgctccagagcattgccacaagctgattttccggccatatgaagctcatgaacactagactgaaggtacacatgatgtgcatacatatgcagtgttgatgagcatcgcgcagattattccaccaccatatcgtgcatgtccttataggtgaggagttctaatgccaaggccgcgtcgagaccccgaagttttaccggcgcagcagcgtttggagaatgcgttctgggcgctcctgcgggaacgaccgtatgggaagatcacggtgaccgacatcgttcgagaggccggtgtgaaccgtaactcgttctactaccatttctccgggttgcctgagcttgccgatgccacgatcatgcatgccgttgaaagcataccgatcatggaccacgccaccactgccgagaatctgtggcaggaatggcagcgcacatgcatcgtggcgttcaacgacccgcagatgcgcaagcagttcgaccatcttgccctgcttgccggcccgcatagcacgatcgagctcaccgaggcattgcgtgatttcattcgcctgacgttgctcggcaatttcgatctggattacgatcgcatcgacctgagcacgcgcatcctgctcgatttcacggtcggcggcatcgtcggcgtgctgcgcgattggccgaacatcgagcatcgtctgtcgcccaacgatctgacgaatcccgacatcgccaccgtcgccgcgaatctgcgcaccgcactcgattcgagcgagcaacgccgccctgtgcagtccctgcgctagtccgcagattccgcatgtggtgaccaccgcacgctacgctggtacgcatggaacatgtgcttgactggttgaaggcgaacagtgggaggatcatcttcctcgccatcgtcatcgcgttagcattcgtggtgacgcgtttgctgagccgtggcctgcgcaaggtgctcgagcacaacaagatcccgcaggcgtcgatcttcatcaacatcgcgcgcgtgctcgtctgggtggtcgcgctcaccatcgtgctgcacccggtgttcggcgtgagcccggcgagtctgttcaccgcgctcggcataggcggcctggccatctcactcggcctgaaggactccattgcgaacacgatcggcggattcacgctcatgttctcgcatgtgatccagccaggcgacacggtgagcatcaacgacacgaccggcgtggtgcaagacatcaactggcggcagaccgtggtccgcgagcgcaatggcaatctgatgatgatcccgaactcggtgctcaacaccaccgcgctggagaagctcgacccggcgaacgagtgcctggtcacgatcccgttcaccgccaagcctgacgtcgacacggccaagctcgcccaggatctgctgagcacggtgaacacgcacgcgcgctcgctcatgaacccgaaatacaaggcggtcgtacgctacaccggcttcacgagcgacggcgtgagcggcaacatcgtggcctacgcgaagcacggcgtcgcgctcaccgcgctgtcggacgccatcgcgcgcgcagtgcacagttccaagctcaatctgaacttcacggcgtcctcattggtcggcattgacgaaagcggtgcgctcaccggcaaatctacatcacgttcataagcgccaacaccatgccgaacaccgtcagcgtgatgaacacgcccatgccggcgttgacgaacgcgcacgagcaggcagtgcctttcggcagttgcgcgggcgtgacgtagaactcgagtctgcggcatttcacaatgagcagcaccacgcccgcgaccacggccaccaaatacagcagaatgtacagcatggcggccacgcccacgacgagttccggtccggacacatcgccggcatcgagcgcggcggaatgggcgtcgctccagtcactgaagaacggaccgaccacgctgcccaggaaattgatcgccatgtgcaatccgatcgtgtatttgagctggcttgtgcgcatgtagatgtacccgagcacgagcccgagtccgaacgcgtagaagaactggtacagattcaggtggaacagcgcgaagacgagcgccgacaccactattgccaaccgctcgccgtagcggcgcacgcgcgcgatgatctgcttgcggcacagccactcctccacgatcgggcccacgaccaccacggcgagaatattgagccatgccgggattccgccgacaatgttgtcgagacggttctgtgccatgccgcccgagaacagcgcggcgagcgcgttgccgagcagtccgcccacgaacacgatggccaggctcacgaggaaccattcgaacagttcgccgaaggtcatgccgaacttgcgcgtgggctcctcgggcacgctcctgagcatcaggtaggcgagcggcacggccaccaggtaaaacgagcagtcggagacgagcagcgacacccacatccagtgcgcggcttcgcggtgcagcatgctaatgccgatcccgagcacgaacacgagcgccatccacaccacgatcatcacgctgaacgacgcccctatgcgcgagtaagacctgcgcgcggattccaccgcattccgttcgcccatctgattcatcggcggttcctgccaaggattctgctgcggttcctgccaatactgcggctgctggaactcgccctgccacgcctgctggaattcacccgcccgtgtgttctgttgcggactctgcgggcgtcccggttcggtcattgtgctccttgcgctcatctgccatgaaatagcctcagattaccaaacccgccttgttgccgtcctcctgttccatatccgcccgctcttacccagttttgcgaaacaaaccaagtggaccgcacttgattccgctcggcagtgtgccgccgcggtaaaggaacacggaaaaagcggcacccgaaattccggatgccgccctgtcgcgcgaatctgcaagcaaatctgccgcggatcagtcgttggtggaggtcttgtcgtagagtgtcttgccctccgacgtgatcacaatgcgcaccgagtaggtgttgccgccgtcctcattgagctgcgaagccgcggatttgcccaccgaattgaggctctcggccagcgaatcggagtattccgcgagcgaggaatccaggtcgaaggtgaggatcagtgtgttgccctcggcggagacgctgcccttcatgccgtccggcagaccttgaatctgcttttcgagctcgctcttcacggtcgggttcttgagcgcctcttcgagcgtgatcgagccgccggtgagctggccgccgatgtcgtcgatgtcgttgtcgatatcctcgtcgatgtcctcatcaatgtcttcgtcggggtccgtggtgctctgggtctgcgaatgcgtggcgctcggcgacttcgaatcgctgacgatctcgttcgtcgccgccagaacactgttgaacacgatgatcgacacgatgatggagaccacggtgagcacgccgcccacaatcgtaccggcgagcgaaagattcttgctcgctttgctgccgccgtgcttgttgatgttcaccattgcgatgatcgacacgatcagaccgatgagcgggaacagaatcgccagaatgagaccgacgattgccatcgtgttgtacttgtcggtgggaccctgcggcgggtactgatcatagccaccctgcggcgggaactgtgccgggccgccgtatgcggggccacccggttcaccgtagaccggcgctcctcccgtgggcgctccgtatgccggctgctcgccgtactgcggtgccgcgttctgcggggcgccgtagttgatctgggtcgtcggctgcgtgcccaccggctcatacggggtgccgtacggctgctgtgccggctcgttgccagtgaactgaggcgcagattcggcatgcccgtaattcgagttgccgtatgcctcgcgcccctgctctggcgctgcgttctgtacatatggctgtgccggttcctgcggctgcgtgtatgggttcggattggcattcggattcagcccgtacggatccgccggcggcgtgattggctgtgctggctgttcgccaccggtgtacggattttctggctgtgtcattattctccctctgtcgaaaaacagcaacagcctatcaaattcgcacttggtgtctagtcaatcattccatgtttttatagtttgctttctcagattgtgtcgcttgaagattgtttctcgccacccatgcatgtggatgctcagaatggtgggattagtcgctgccggtgaggtcttgtcgtaaatcgtcttgcctcccgacagcatcaccagtgcactgagaacatggcattgcgtcagattggcggcaacgtacatccgcggctcaggcgagcgcgccttcgatgaggtcggtgaccacggtgcggaacggaatgcccatggcctcccacgcttgcgggaacatcgaaatcgaagtgcaacctggcagtgtgttgatctcattgacaagcacatcgccatctgcggtcacgaaggtgtccacacggctcagtcccatgccgtccaccgcgtcgaatgcgcgtacggcggtctcgcggacgcgcgcgatcaggtcatcgccaatcttcgccggaatctcggtgtggctcgcctgggagtccatgtatttgctgtcgaaatcgtagaactggtcgtcgccttcgctgcgccggtcgagcaccacttcgccaggtagcgcggcacgggtcgggtcggtcgggtgaatgcgcaccacagcgcactcgatttcgcgcgcgtcaatgccctgctcgaccagcacgcgccaatcatgccggctcgcctcgaacacagcggcggcgagtgcggctgcgtcgccaatctgctccaccttggtcacaccgaagctggagccggcacggctgggtttgacgaacaacgggtactgcaaaccggcctcgttcacctgccgcaggaattcctcgccgtcggtggcgaactcgtcggaggcgtcgtagtgacgggtgtcgagcgtgatgcccggcgccaccggaatgccggcggcgcgcaacagcaccttggtgtagtgcttgtccatgcacgcggccgaggcgagcacgccgcagcccacgtacggcacgcccatcatctcgaacaggccttggatcgtgccatcctcgccaaacgggccgtgcagtgcgggcagcaccacatcaatgtgaccgagcgaatcaagcgagccgtcagcattgcgggcgtggaacccgtcgccaccgtcgccaatggtgagcaccacttcgcgcgaatcgggcgtctcaaccgcctcggggagtccttcggccagattccaaccgagcggatcctggccgtctacgaaccaggtgccggtcttcgtgatgccgatcggcacggcctcgaacagttcagggtcgagcgcgcgcatgaatgaggctgcggagatgcaggaaatcgaatgttcgtccgccttgccgccgtagagaaccgccacccgtgtcttcgccattgccatctccttatgcccgggcatattgcgcccgggattctgctccatgccttgtgagccgccgcctccgcaatgaacggaacgcggcgcccgcgctgcctcccaagaatactagccgctctccccgccctccactcttgcgggccactttacgggctgctcttaccggccaagataactgttacgggccaacatttcccttacgggccaaactatttcttacgggctagccttttctgttacgggatgtcacctgccacggaccaatctaccccttacgggcaaggcccccaacgcaaaagcgcgcccgcaaaccaaatgcgggcgcgccaatctacaaaaatatgcgaattcgggcgggtcactccacggtgatgccctgcgggaacatctcggagaccatctggctgaaggagatgccgtcgtcgagcacgcgcgtgacggccttggcgagcggggtgtccacgtggtacttctcgccgagctcgacgaccgcgctggccgtggcgacgccttccgccacgccgtcgctcgccttcgtcgcctcggcaacactcatgcccttgccgaggttgaagccgaacgtgtagttgcgcgagagcggcgagccgcaggtggcgatgagatcacccacgccggcgagtccgtggaacgtctccggcagggcaccggcggcagtgcccacggcggtgagttcggcgagaccgcgcgtctcgatcatcgcggcggtgttctcgccgtaacccgcgccgtggctcatgccgacggcgagcgcgaccacgttcttcagcgagccgcacagctccaagccgatcacgtcggcggtgatgaacgccttgaaatagtcggtggtgcacagattggccatcatgcgcgcgttgtcgatgtcggtgcagccgatcacggtggcggcgggctggcgcgcggcgatctgcttgctcaaattcggtccggagaccgcggcgaatcgctgggtcggcagatcgagcgcctcgcagaccacctggtccatgcgcttgccggtgctcttctcaatgcccttcatcagcgagacgatgagtgcggaatctggaatgagccctttgaattcctcgagcgcgccgcgtgcgtactgcgcggcgatggccacgacgaccacgtcggcatgcgcaaccgcttcggctcggtcgccggtcgccttcatattgtccggcagtttctccacgctcggcagacgcaccggattcctgtgctcggtctggattgccttcacgatctccggctcgatcgcccacatcatcacatcgttgcccgcatcggcaagcacctgaccgaaggcggttccccacgcgccggcgcccaaaactgtgacattcgccatgcctactccttacttgagacagctattctcgattgtcgctcgctttcgccgtcgcgtccccgcattgcgttgctagcgcaaatccggcgagctgtttgccgatttctccgtctcaccctctcgctcttctatcctctccgtatctcttacgggatgccataaaccgctacgggatgtcacaaacctttacgaaaggtcaggaagcaaagtgccgacgcgacaaaacccttggaaaatggcccttttcaaacttcacgttttcgagcgagcgtcacaatccaatatcccgcaagaacttatgacatcccgtaagcattaacgacatcccgtaagcattaacgacatcccgtaagcattagcgcgcatgcgagcttgctgaatctgcagattccacagattccccaacgcgcacctccgcttcctccgcgcgcctgtcaatctcatgcgggtcgctgaacggcggcacttccggcacttccttctcgatacggtaatcgtagaacgtgtcgggcgccgcagtgccgcggatgttcgccatgacctccttcatgcgcacgcgcacgcgccgcacgagttcgttcgcgagctcggtgggcgggtcgtcgccccacgagtccatgttcgcgagcaagtcggagtaatccagctgcgtgtcgtagcacatgacgacgttcttgcgcggccacggccaccaatgattgatgctcgccgcaccccacgtcaccgcgcagaacagcggaatctggtgaccgacgcggcgcgacgcctcgagcgcgatgaatccggcgccgttcttcatgctcatcggccactttttcgggtcgcgcgtcaccgttccctcgggccagatcgtcagcgcatgattgctcgtgagaatctgtaccgacgcttcctcgatctcgcgcgccttgccgctgcgtcgcggcaccggctgcatgcccaccgcgcggaaccatttgcctatgaccggccatttgcccatctccgccttggccatgtaccgcggacgacggcccatttggaacatcgcgaccatgggcacgaacacgtcgaactgcgtgacatgcgttgcgcaggtgatgtaggcgccttccaccggcacgttttccaagccccacgcgcgcactttgcagctcgcgcgcagaactttcgccgcgccttccaccaagcggtgcgtgattttcggattgagctcatcaatttcccgctgattcggctccattctgccgatcgggaacggacgcgtcgggtccacgagagcatattctgcggcgagtttgcgcacttgcgcgtcgctgagcggcttcacggcgcgccttggcgacggcttccctttcgataccatgcccccattctgccacgccccctcctctgcacgcctctgccgcaccttcggcaccccggtccccctcagcacccagcgcccctttgtgtaaaaagagacaaagcagagccccaaaatgtcccaaattatgcaaacaaaaatctgccgacaataatctgcgtaaaaggggacatctacatgctggtagatgtccccttttgcgcagattcaagattcagcctacgcgcggactcaccggccgcgcgctaggcgcccagatttccttacgggatgtcgtcaacccttacgggatgtcacggcccaagtatcggtaccaaaaaacattgaaattcccgctatattgtcgtgtttatcaactgcggcgcgagaatctgacatcctgtaagagttgacgacatcccgtaacgaaaaagaagcgccataacgcaaaagacggccgcccccagcaggggtgaccatcttcaagcgttctgttcaagcaagcagaacggcgcaaactagtcgatctgcgcgccgagcgccgtgagcttgccgcggaagtccgcgtacccgcggtcgatcaggctgatgccgcgcacgtcggacggtcccttcgccgccagcgccgcgatcaggtggctgaatccaccgcgcagatccggcacgtcgatgtcgcgcccttcgagcggcgtcggcccgaagatcacagcggaatgcttgtagttgcgctgctggaagcggcacggcaacgagccgaggcattcgcggtagagctgcacggttgcgcccatctccaccagcggcttcgtgaaaccgaaacggttctcgtacacggtctcatgcacaatgctcagcccgttcgcctgcgtgagcgccacgacgagcggctgctgccagtcggtcatgaagccggggtgcacgtcggtctcgatcgccaccggcttcaggtcgccgcccgggtgccagaagcggatgccgcggtcggtgatgtcgaactcgccgccgattttgcggaacacattgaggaacgtcatcatctccggctgcgtcgcgcccttcacgaacacgtcgccgtgtgtggcgagcgcggccgacgcccacgacgccgcctcaatgcggtcggtgagagccgtgtgagtgtagcccttcagctccttcacgccctcgatgcggaacgtgcggtccacgtccaccgagatgatcgcgcccatcttctgcagcacggccaccaagtccatgatctccggttcggtcgccgcgccggacagctcggtcttgccatctgcgagcacggcggcgagcagagtctgctcggtcgcgcccaccgacgggtacggcaggtggatcttcgcgccgtgcagaccgttcggcgcggtgatgtgaatgccgtccttgtgttccttgtcaacggtggcgccgagtttgcgcagtgtctccaaatggaagtcgatcggccggccgccaatgttgcagccgccgagcgccgggatgaacgcctcgcccagccggtgcagcagcgggcccgagaacaggatcggaatgcgcgacgagccggagagcgtgtctacatcggccacgtcggccagctgcacgttcttcgcgtcgatcgtcacaatgccctcgtcgccgttcacgtccacgttcacgccgtgcagacgcagcagatccgaaaccacatgcacgtctcgtatttcgggcacgtttttgagcaccgacgtccccggcgcgagcagagccgccaccatggccttgcttacgaagttcttcgcaccgcgcaccttgatcgtgccgttgagcggcttgccgcccaccacatgcagtacgtcgtcagttttctccacgtccacctctttcaagctctttcaagcacacgattcgagattcctaaatgcttccaacagttcccgcgcgcgttttatttcggcaccgcctcggtaccgcccgcgagcgcaattccccaccattctgccacacaccatgtagttcttcatatgggcagattcccccgcgctcaccattcgcgaaaccccgcgccaccgcccgcaccccacacctaccatctcaggtagcactagtgttttcgggactcaaaggagcatcatgaccaccactgtcgccgttgtcggctgcacccacgccggcgttttcgccgccaattccattcttcgcgaacaccctgattggcaggtgcacgtgttcgagcgcaacgagaccgtctcgttcctctcctgcggcatcgcgctgtgggtgggcggccacgtctccgacccgaagaagatgttctactcctcccctcaagcgctcgagcaggcgggcgcgaccgtgcatatgcacaccgacgtcactgacgttgacgttgccgcgaaaacgttggaattccgcgatttgcagaccggcgacacccagaccctgccctacgacaagctcgtcgtaaccaccggttcgcgcccgatcgtgccgccgctgcccggcatcgattccaagcgcgtgcagctatgcaagaactgggatgacgcggtgcagatcaaggagcgcgcgcacgatctgaagaacgtaatcgtgatcggcgcgggctacattggcgccgagctcgccgagcagttctccacgcgcggcacgcaggtgacgctgatcgacgccgccgaccgcgtgctcgccaataatttcgacaggttcatcaccgatcaggttgaggcgaagtaccgcgagcatggcgtgacgctggcgcttggtgaagcggtcaaggcgttccgcgacaacggcgacagcatcaccgtggtcacgacgaagggcgagtacacggcgccgtacgcggtgcttgccgtcggattccgcccgaacaccgacttggtgcgcggccaggtggagacgctggacaacggcgcgatcgtggtcgacgagttcatgcgcgcctcggtgccggatgtgttcgcggccggcgactccgccaccgtgctgttcaacccgaccggcaagctcgactacattccgctcgccaccaatgcggtgcgtcagggcgagctcgtcggcctgaacattgagaagccgacccgcaagtacatgggcacgcaggccacgtcggccgtgcagctctacgacctctcgctcgccgcttccggcatgacgcagacctacgcgaacaaccacggtctcgacatccgctccaccgagctgcttgaagattaccgtcccgcattcatgctctccaccgcgccggtctcgtgcatgctcacctgggatccgcagacccgcctggtcaagggcgcccagttctgctcgaccaccgatgaggtggccggcgccgcaaacgtggtctcggtggcgattcaggcgaagttcaccatcgacatgctggcgaacgtggacttcctgttccagccgaacttcgaccagcccgtctactatgtcggcgcggtcgccgcaaaggccgccgccgagcagcgctgactcctgcatgccctcctgttggggggggagtcccccagcatggacttcccccccccccccaacaggagctcctccaggggagacaccccaagaggagacccccacttccccttcttcttcctcttcctcttccttcctcttcctcctctcctttcccttacgggatgtcgtcaattcttacgggatgtcataccctgttacgggatgttttattgttctcggcatgaatttcaaatggcccaaaacttatcaaatagaaacatgacgacaggctgggcgaacattcacgatacaattgttcacattctcgcacaggtctacttgatgcatgacatcccgcaacagatgacgacatcccgcaacagttgccgacatcccgtaagcgaggaaagatacctctcggctctacattacgctacgggccagccccacctctgcagacaacccctctcctactctttttcattcaaactcattcatctaaactcgcctcatctcacttactggtcaaaccacaacccacctctttagggtccacgatgttctcaggggtacaggtcttctgctcagaggtacagagtgagtttcgactgtgaaacaatcgggacaccgctgacacaggctcttcctcgggggtacaggcagagttttgagggtacagggctataagaatgcagattacaagaaatccttatttttcaaagatttatgaaatctgttaacagataaatccgtgctccttaacactctgcctgtaccaccgaggaagagacctgtacccctaagcacgaatctgttattaccttagcccgtaagagatagcagattaagagatgacaataggcgcgtaaagaaaaacggcccctccgtgcggaggagccgtcagcggaatacacgacaaaaccggcgagctcagtcgccaccgagatcgaatgcggcgagatcgtcttcgcgcgagtaagtgcggaaggccatcaacgtctgcgtgccggcgacgccgggaaccttggcgatgccgtcgggaatgatcgtcgagaggtcgtcgaaatcgtcggcggagacgatcgccaccaaatcgacgtcacccgccaccgaatagacgtccttgacgcccggaatctcaacgattttcttcgccgcctcgctcaccttgtcggcttgtgtggtaatgagaacgattgcatctgccatctcggctccttagaacaacttcccgttccttcaacgataccccgcgcagcgccgacgcatgccgctcgccgcgatgcacgcagagcaccctaacgaacaccctggccataagcactgtgacatcccgtaacagcattgttggccggtaggtactgtgacatcccgtaacgattatgttggccatacgcactcacgccacgcgactcaagccgcgcgacgcacgaccgcacgccgcccgcgcggagcgcctcgcctcagcgatcggcgagcggacccgcccactcaaccgcttcaggctcgcgtgccgactccaccgtttcagcctcctccgtgatcgcaggcagcgtcttcggtttgaacgggaatttttccgctcgcatgcgctcatacgcggcgatgtcgtcctcgtgctgcaacgtgaggtcaatgtcatcgtagccgttcatcaggcgccagcgcacgtaatcattgacctcgaacggcagcaccacgtcgtcgatggtcacggtgcgcgtctcgagatcgacggtcatctgccggccgggctcctcttcgagcatcttccagatcagctcgatcgactcctgcggcataatcgcagccagcacgccgttcttcgcagtgttgccatagaagatgtccgcaaaacgcgacgcgatgaccacgcggaacccgtagtcatgcaatgcccacacggcgtgttcgcgcgacgaaccgatgccgaagtcgggcccggccacaagaatccttccgtcgcgatattccggctgattcagcacgaaattcgggtcgcgacgccacgcgtagaacagcgcatcgtcgaaaccagtgcgggttacgcgcttcaggaacacggcggggataatctggtccgtgtccacattcgagcggcgaagtggcacgccggtagcggtaatagtcgtaagtttttccataacagtccctatttccgtaagttttcagattcccgattcacagatccgccggcgtcgagattgtgccgcggatcgcagtggcggcggcgacggccggcgatgccagatgcgtgcgcgatcccttgccctgacgcccttcgaaattgcggttcgacgtcgagatcgagcgttcgtgggcgacgagtttgtccggattcatgcccaggcacatcgaacagccggcattgcgccattccgcgccgaaatccttgaagatccggtccagcccctcgcgctcggcctgcaggcgaatgcgcgacgacgcgggcacgaccaaaacgcggtgaatcgaatccgccttcttgtgccccttcataatctcggcggcgatgcgcaggtcttcaatgcggccgttcgtgcaggagccaatgaacacggtgtccaccggaatgtcgcggatcggcgtgcccggctcgagtcccatgtagtcgagcgcgcgctcggcggcggagcgttcggtggcgtccgcgaaatcgtccggcgcgggaacgacgcccgaaatcgcgacgccctgccccgggttcgtgccccaggtgacgaacggctcgaggtcttccgcgcgcagcgtcacttcggcgtcgaacacggcgtcgtcgtcggtgcgcagtgttttccagtactcaaccgcttgatcccacatctcgcccttcggcgcgtgcggccgccccttcaggtatgcgaacgtcgtctcgtcgggcgcgatcatgccggcgcgcgcacccgcttcgatcgacatgttgcagatcgtcatgcgcgcgtccatcgacagctgctcaatggcgcgcccgcggtattcgagcacgtatccctggccgccgccggtgccgatcttcgcaatgatcgcgagaatgatgtctttcgcgctcacacctgccggcaggtcgccctcgatgttgatcgccatcgtcttgaatggcttgagcgagagcgtctgcgttgccatgacatgctcgacttcagacgtgcctatgccgaacgcgagcgcgccgaacgcgccgtgcgtggaggtgtgcgaatcgccgcacacaatcgtcatgccgggctgcgtgagaccgagcatgggcgcgaacgcgtgcacgatgccctggtccgcgtcgccgagcgggtgcaagcgcacgccgaattcgcggcagttcttctcgagcgtcgtcagctgcgtggcgctcgtctcgtccgggttcggcttgtctatgtcgaccgtgggcgtgttgtggtcttcggtggcgatgagctggtcgaggtgccgcggtgtgcgaccggccaggcggagcccctcaaacgcctgcggactggtcacttcgtgcatcagcatgaggtcgatatacagcaagtcgggagcgccgtcgctgcccttgcgcaccaaatgatcggcccaaaccttttcggccaatgtcattcccataaacctgttcctcctagtgttgtcgcgtgtgcggggcgcgctctcccttgcttttcccgcgccgctcgcttaccacacgcgagcttgtctgtccagactaaaggttggcgaatcgccggtcgcgtactatgtcagaatgcgagatgtgaaggttttttcaaagatgttgcagattgttttcgcactgtaaaacacctgattttccgcggaatttgagcgcttaagcagactaatccaacagaaatgcccagtttgtcgttttgcgtttcgaatactgagatgcaataatctcagtatgacttcagatacgcttgccgcaaaatctgctccgtctgctgagacgagcacaaacaatccgtccaatcacaacgatgtgcctgcagacgacaacgagattcattccggcgtcggcgtgctcgacaagaccgtaaagattctcgatgcgctcgagtccggccccgcaacgctcggtcagctcgtcgcggcgacgcacctcgcgcgcccgaccgcgcaccgcttggcgatcgcgctggagcgccaccgcttcgtggtgcgcgaccagcacggccgcttcgtactgggctcgcgtttcaccgagctcgccgccgccgcaggtgaggatcgcttgctcgccgccgccggcccgattctgcagacgctgctcgaccgcactggcgagagcgcgcagatttaccgtcgtcagggcgaacagcgcgtgtgcatcgccgccgtcgagcgcgcgagcggactgcgcgattcgatcccggtcggcgccatgctctcgatggaggccggttccgcggcccagatcctgctggcgtgggaagacaccgaactccttcaccagggcctgcgtcacgcgaagttctcggccgccaagctcgccacggtgcgcaagcgcggctgggccgactcgatcaacgagcgcgatgagggcgtctgctccatctccgcgccgattcgcaacgcctccggccaggtaatcgccgcgatctcgatctcgggaccctcgggccgcatgggctcgaatccgggccaccgtttcgccccgctcgtcatgggcgccggcaagtacctttccgatgcgctgatcaaggccagcatctcgcgctgaccgatttcggcggccatccgatgcccccggaaccgcaacgcatccgatatcatcgcgttcaagtaggcaactaacctacgcacattccgcaaccccataagtaggcaaccgacctacatacattccgcaaccccgcaagtaggcggccagccccacggttggccgcctttctcttttcgcgtctccgtctcatacaacgttacgggctaaggttttctgttacgggatgtcataatctcttacgggatgtccttatccgttacgggatgtcaccagctgttacgggctatggggccccttacgggccagccaactccttacgggctaggcctttcggttacgggctagcgaaaatctgcaacctggcaagtatccagcaattccccaaaaacacaaaaccgccattttccaacgattgttgttgccgaatacaacgccccttttagcccgtaaccaaaaatcctagcccgtaagcgttatcttggcccgtagcggctaccttagcccgtaacagaaaatcccagcccgtaagccaaaaggccgtaacacacaacgagacgacggcaagacgagccaaacgtcgtgccggcaacgtctcccacgctcacatggttttggtgtgacgcaaaccgctttggtgtgacggcacccacaaacccatgaccataacaatgttggaattccaacgttttgcaaatcgaggccaccgagccatcgtcacaccaaaacggcatgtgtcacaccaaaaccgtaaaacctccgcgctcagtgattgaacagccagttgcccacggaatgccacaatctgctcaccgtgctcggcttgtgcagcaggttcacgccctcgcttttcggcttcgacgcgctgctcatgccatacacatacgccttcttcgagctcggcttgcccaccaactcgccgaactgcagcagctgcgtgcgcggcgagaacgggtgccgctcgtcgaactcgaacagacgcgccgcacgccgttccggaatcggcccgtacgagtcgaatccgcacgtcggcgtcgcaatcatctgcacgcccgcatactcgccggcgaacgcgttacggtggtcgtgaccggccgccaccgcgaagtaggcgtgcgaatcgcgcagaatatcgaactcgcccgagtcgaggtccgggcagctcacgccctcgcccaaatatccgccgcgctcggtcttcgcgtcgtccagcacaaagtatgaaccggaataatttctgtacccctctacagaccgatccgtcgttctcggcactggtttcagcacacggtaatactgcggcaacggcatatgctggaaaactatggattccacgccttcgccaaaccactgcggcacggtgcgcaggaatcgcagcgcggtctgcgacggtgcgccatagccgccggtttccgaataatctccggaatcgacaagaactattccgaaaacagtgtttccagattcgtcacacaccggcatcgagaacgtgcccggctcgccgctcgcgatcacacgctccttcggcagcgcgcgcgaccacgtctccgcaccgaatttcgcgcgcgtcgacggattcacacacagcgggaattcgcggaagatcccgtcgagctccgcgttcgtgagcccgcactggaagtcgtggttgccgtacgtcaccgcccacggcacgcccgcgtcaaccatcggctgcaccatctgctcgatctgcccgcgcacgagctcgcgcgtgtgggcgaggtccgcagatttgggcgccgcacccaccgccgtcttccaccggcgtttcgtgaacgtcgcggcgaacgcggggtcgtaacctgcgatctgattgcccgagaacaccacgagatcgggccgcgcatcgcggatcgccgccgtgatgagcgcaatcgtgtctttcgagatcttcggaccgtcttgcacgtccgccagctgcagcacacggaatttccccgatttgtggaactgcaagcgcccgagccggcgcgacaccgacaccggcttggcttcgctcatttccgcagactgctcactcataccgcctactctaacccatccgccgcgcgttcgcacgccagtcgcgtcttgcttcacccctgctcacaagcggcagacaaaacaaaaaacctccacactgagtggaggttcattcgctgggatgcctggactcgaaccaagaatggctgaaccagaatcagctgtgttgccaattacaccacatcccaatttggcatgttcattcggtttcccgaagaactcgtacccccaaccggatttgaaccggtgttggcgccgtgagagggcgtagtcctagaccgctagacgatgggggcatcatctcgtcgcttccgtgaagcaacagatagaaaatatactcgaaaccccgaatgtgcgcaactccggcgtgtcgcacccgcatgcccccagttttcagccagcctgcacgcccccgcgcgccctcgcacgccctcgcgcgctacggcgtgaacaatgtgatgttatggcgtgaacatcgtcaaggtcaccaatcgcagattccttggaatatcagtggttcgaccaactgcaacttttgccttgttcacgccataacgccggttgttcactccgtaacgcaaaaagccgaggctcccacctcgacttcattgcttaacggtctcacgactaaacggacctcatcgctcagccctgaatctcagcgagatgctcgcgcagaccacgcaggcgctccagcgtgatcttcttgccaacaatctccatcgactcgaacagcggcggcgaaacacggcggccgctcatcgccacgcgcaccgggccgaacgcgagacgcggcttgtagccaccatcttcaacgagcgccttgttcagtgtctcatgcagcgtatccgttcgccacgaagactccggaacggaatccagcgcggcaatcgccaaatccagaacggcgccggctgaatccttgagctgcttcttcgcatcatctgccggcggaatgtagtctgcgtccgaaagcagcgagccgaccatgcccgcgacttcgccgagcaggcgcacgcgcggctgcacaagtggcgcggcggcagcgagaatgtcgcgttcgcgctcgttcagcgcatcccacgaatccgcggagaccacgccatcgcggaacaggtagggcaccgagcgctccaggaaatcggcaggctcgagcatgcgaatgtgctcggcgttgatcgagatcgccttgtcaatgtcgaagcgcgccggattcgccttcacatcgcgcacgtcgaacttctccaccatctcgtccattgagaagatatcgcggtccggcgcgatcgaccagcccagcaacgccagataattgagcaggccctccttaatgaagccatgctcgcgatgcaggaacagattcgactccgggtcgcgtttggaaagcttcttgttgccctgacccatcacgtacggcaagtggccgaacagcggcatctccttggcaatgccgagttccataaggtagcggtagagcacaatctgacgcggagtggagctgagcagatcctcgccgcgcaacacgacattgatgcgcatgagcgcgtcgtccacggggttcgtgagcgtgtacagcgggtcgccgttcgggcgcacgatcacgtaatccggcacagaccccgccttgaacgtgatctcgccgcgaatgaggtcgttgaaggtgatgtcttcgtcgggcatcttgatgcgcagtgccggcttgcgcccctccgcgcggaacgctgccttctgttcctcgctcagattgcggtcgtagccgtcgtagccgaacgccttcgggcgccctgccgcttcgttgcgcgcctcgatctcctccggcgtggagtatgactcgtacgcatagcctgcgtcgagcagcttctgcgcgacgtccgcgtagatttgcccgcgctcgctctggcggtacggaccgtccggtccgcccacgccgacgccttcgtcccagtcgatgccgagccactgcagcgcttcgatgatctggttgaagctctcctcggagtcgcgctgcgcatcggtgtcttcgatgcggaacacgaacgtgccgccggtgtgccgcgcctccgcccagttgaacagcgcggtgcgcaccatgcccacgtgcgggatgccggttggcgacgggcagaacctcacgcgcacgttctcgggaagcgcgggtttcacatgattcgactcattgttttcagattcactcatgcccactattctgccccgccaacccgacgtgcgcggcgcttttgtggctcttctcaagttagtgtgtaagggccgtgcttcatcattgcttgtgtgatagagaaattgaatgaggaaacacggcctgaacccgagtttagcgtgttcgacccccaacgtttccttggtttggatgagatgggtcttcgtgtgctctcgtggcggcgtcttggcaggccggacggcccggggttaaggcagatcaggtgcgagccggactcgcacgacgcgcgctggtgcccctcgtgcggcgcgtatgccagggtgcgttcgtcgtggctgcgcacgctggcgcatgtgccctacggcgacgacgcggtgcatctgctggtgcgcgtgcgccgctacgagtgcgtgccgtgctcacgctcgtggagcgatgatcttgaggcggtgggcgccggcaggggcgtgttgagcgtgccggcggtgatgtgggcgctgcggcgcgtgtgcctggactcgatgacggtctcggcgtgcgccaggctgcttcatgtggcatgggcggtggtcgaccgggcggtgcgcgagcggggcatgctgttgctcgagcaggccgaccggttctcctcggtgcgcgcgatcggcgtggacgagcacgtgtggcgccacggcgcgttcggcgaccggtacgtgaccgtgatcgtcgacctgaccccgcgttgcgacggcaggccggcaagactgctggacatggtgccgggccgttccgcccaggtgcttcgcgaatggatgcaggcgcgcggcggcgagttcacaagacgcgtcggggtggtcgccatggacgcgttcgccggctggaagcaggccgtcgaatccgtcgtgccccacgcggtcgaggtcatcgacccgttccacgtcgtgcaactggccgccgcccgcgtcaccaaggtgcgctgccgcctgcaacgcgacgccaccggcaggcgcggtgtcaagggcgacaggctctacgactgcaggcgcgccctgctgaccagcgacgaatacctcggcgcacgcggccgtgccagactcatggccctgttcgccatccaggccaaccgcgacctcatgctcgcccacgacgcctaccaaagggtcatacacgcctaccggtgcgacgacaggcgacgcggcgaacgcatgatgcgcgagctgatcgacgacctgaccggaccggggcgctacaaaggctgccgggaactcgcctccctcggccgcgtgctcaaaagacgcatgcgcgacatcctcgccctcttccgccacccccgctcaagcaacggacccaccgaagccatcaacggcaggctcgagaccctgcgcggcaacgccatgggcttcgccaacaccaccagctacatccaacgatgcctcatccacagcagccaactcaaagacatccttacacactaacctgagaagagccgcttttgtcgaggatgccgattagctgccgctatctgctgcaggccatctgctacgggccaaactaacccttacgggctaagattccccttacaggctaggatttcctgttacgggccatcccccaaatccgctacgtccccaaatctgttacgggctaccctaatctgttacgggctaccctaatctgttacgggatgttttctttctttagaaatgaatttcaaattacacaaaatccaacaaactaaggtcttctgtctcatcaaatgaacacaaatcatatgattgcaaacattttcgcacaactctactcgggccgtggcatcccgtaagaaataatgacatcccgtaaggcacatcttgacccgtaaggggaattgtagcccgtaagctacgcggagatctcggtgagcaccggggtctcggtgctcgtcttgatctgcttgaagccgagcagcgcaatcgccagcgacacgaacgcaagcgccgtcaccactgcaaaaccgccgtgggaaccggcgcggtcgatgaatacgccggcgaccgccgaaccggccgaagcgccgatcgagttcattgcgcccatccacgccatgccctcggtgaagcgggtctgcggcacgagatgcagcatgagctggttgccgttgatccacgtcggcgactggcatacgccaataatgaggtaaatcaccatgatcacccacaggtggcgtgcgaacaggaacgagccgatgccaatgttcaacaccgcgaggcacacgtagaagcgcttccacagcgggatcgtccagtttttcgcgccgtacagcagcgcgccggtgagcgacgagatcgagaagcaggcgaacacgaatccggtgtactgcttcatgttcgcctccgtggcgaaggcgatgatcgaaataccggccgccgactggaacgcgccgagcccgaaccacgtcgcgcacacggcgatgagacccggaccccaaatggagtccttgatgccgctcatcgaccgctcgtacgccgccttgcccgcggcctccacctcggcgtcggacaggccctgcgacttcgcgtgcacgcgggcgtcttcggcggcggtctgcgcgcgcagctccttcgccttctccgcctcgcgctcacggaattccttgcgcgagaccccggcttcgcgggcgaggtcagactggctcggcgggcacgtggtcatctccgtgaggaacatgagcgcgccgatcagcacgcagattccagtgaacgacatcgccagaaatcccgagatcacagccaacgtggacgcgagcggattgcccaccacccacatcgcctcgtcgaacacgcccgacagcgagagcgcgcggttgacgccggcgcgatcgttgcccatcaggtacgtccagcgcgcgcggctcatggcgccccacggcggcacggcggcgaagaacggcacgatgcagaacaggatccacggcgtcacttgcgcgcgcacgcaggtgacgaacgagacggcggcgagcatccagatcacgatcgtggggattgacacctgtcgctgcccgaatcggtcgacgagcgtgccgagcagcggccccaccacggcgccggcaatcgcctgcactgcggtgagcgcgcccgcgagcgagtaatttccgtaatattgctgggtcatgatcgtcatcgtcatgcccaccatcgggaacggcatgcacgcaatcaccgatcccaccgtgaacctcgccgcatgcgggattctcaacaactccgcgtacccgccgaaaatacggtggttcacgtctttcacaccttgcagtaacgacatgtgccgctcctttctgctcactaccactcccgactgcgccgctttgcgtcgcggcccgctatgtttcgccgggattttcctgttttcagattccgtccgcccttatattccgttacgggatgtcaaatcggttacgggctacatttcccgctacgggctatgccaccccttacgggctaggctctttcgttacgggatgtctgtgcgctgcgaatctgaaattatatgccgccgcccagcaacaccgcgtcacgtatgcgctgttttggcaaacatggctacactacagaggggtaccatcgcgacacgcggtacattggtagcagcgacaaagtttttccataatgatttcgcgcggccgaacaccgcatgcgaacgtgtgacctatgcaagcgaggagcccggaatgccagccaccaccatcaacttcgtacgtcacggcaaggtgtacaacccagaccatttgctgtacgaacgcctcccggacttccacctctccgagcgcgggcgacgcatggcgcaggcgaccggcaggtatatcgcacagagtccgcagctgaacacggctgtggcggtctactcgtcgccgctcgaccgcacgcgcgagacggcgaacgagattctgctcgaactcaacaaggtgcgggccgagcgcgggcaggaggcactcggtctgctcaccgacgagcggatcatcgaagcgggcaacgaattccgcggcacgcgcatcgggcatggcgagggcgcactgtggaagccgcggaatctcaagctcgtgcgcaatctgtggacgccaagttggggcgagagctaccgctcgatcgccgctcgcgtgcaggatttcgcactcgaaaaggtgcacgaatacccgggtgagcagattgtggtcgtcacgcacgagtcgccgatctggtcgtaccgtcacatgctcgagaccggccaccccgagcacaacatgctgctgcgcaagaccgcgctggcgtccgtcacctcgatcacctacgattccgagaccggcaaggtcctctcgatcacctacgccgaccccgcgaaacacatcgactaataccacgggctgcctcagcccccagccatcatcatctcttacgggatgccactcctacgggaggccatcaacccttacaggatgccaccaacccttacgggatgtcatcatcccccgatgccatcatccctcggagaccaccctccttcttacgggatgtcaccaacccttacgggatgttttctttcgcaaagaaaatataatagggcggctaaaatctctcaaacaagaacaattttctacgatttcagaacaccaacgatagtttcgtcaacattttcgaacaaccttacttgagcgatgacatcccgtaagagattgcgacatcccgtaagagattgcgacatcccgtaagagttgaaggcgccccgtaggcaacggtgacgtcccacaggcatgaatccgaagaatctgtaagcaagaatgccgcccgcatcgcacgctatcaactatcattactgaagcggagcagcgcacgcgcgaacgaacgccgcccaacatgagaacttcgtgaggaataaggagcatacacatgacgttcaacgatgaacacgccgtcgagcaggtcgcatcgctgcccgcaatgaagaccgccgtgcgcagcggcaccgacctcaccgagctgtggccgctcaccaccgccgagcgcatggataacgacgcaaagtacgcggagaatctgcaggtgcggctcacgctcacaatggcgcgcgtgctcgtcggcaccacggaggtcacgctccccgacgccgaattcgtatacgagggcgcggatgcgattccgggtcgcccccaggaagtcgtcgacgcgcttctcgctgccaatgacgcctatgagcagctcaatccgtactcagattcgcatgatttcagtcttctgttcgaggccgccgagacgctgactgccggctggagcgaggcgacgcaaaaacagctcggcgagatcctcgatgactgcactgcatatattcatgacaccgatcagaagcgcgtcaccgggctcgaccaccgcttcgccgtggtgctggtcacgttcgcgcagatgctccgcgtgctgcgttcacagatcatcgccaatctcggctccgattcgccacacaccggcggcgcctcctccgaccgcgtgcgccatctcgagcgcgtcgcgctcccgctgctcccgttcatcaatgaattcgccgaaacgctgggcgtgccgcgcatctgcgtgaccgccgaccaatggcacggtctgctcgccgcattcgccacgccgaatggcgatgacgactccgcagattccgcccgcgtactcgccgaatccctactcccgcttgccgcggcggagtggcgcaagcaccgcgaagacattctgtgggacccggccgaggccaagcgcgccgctaaggaggaggacgagcgcaagaacaaggaggccctcgccgccaagttcgcgcatatcaaagacgatccgtccaagcccgaagtcgagctctgaccccgcccgctgaccgcccctccttcattctgcgtaatttgggacaaaaccccgccccgatctgtcccaaattacgcagatgggcgctggcccttccctctcccatacccacatcccggaagcctccccaacctgcgacgccccacaaaccactgccaaccgtcgcacctcacccgcgcatcacgctccaagcaagctttcagccgctctgagtacaatcgtcccgtgcgcaaactcattgaacagatcctcaaattcggcgtggtcggcgccatcgccttcatcatcgactggggcattctcaatctgctcgtcggcgtattccacatgcataacgtgatcgccggcaccatttcgttcttcatctcgctggtgttcaactatttcgcgagtatgaaatacgtgttcaagcaccgccccgacatggcgcgctggatggagatggccatcttcctgttctcctcgctcgtcgggctcttcctcaacgcgctgattatctggctttccacctacggcatgaaccgcgacgcgttcatcacccagcatgccgagtatctgctgcgcacgaacatgggcaagctcgtcgccacggtgattgtggcaatctggaacttcatcattcgcaagtggctgctcgacgacacgcacacgaacgctatgaaccgactgcgtcgcaagggcaacgtgctttccgaggaggagcttgaggcgaagtgggagaagagtttctcgcaccgcctgggcatgtggagcatcgagcacacgcccaaaggctgggagtagctctcaagcggcggcacttaagccacttctcgcttacccattccccgctttctcctccatttacgtgggcgcactggttttccgctaaccaccatcgccaattcctctgtcgtgtacccgtcggcgaatactggcatgggctcgtgagtgcgctcctcgattctcgccgcgattctgtaggcgcacgccaactgcgcttctggcgtcgccacgtcggccctcgtcacgacaattattgcccaccccaattccgccagcttatttcttcgcagattatcttcctcccagctttcctcatgctgcttgccgtcgtattcaatggcgattttccactgcggatatgccatatcaagtctcgccgtatgtccgttttccagattgactacatagttgattttcggttccggcaatccgtgcttcatgagtacatctattcgcactatgctttcctgtggcgattcgactcgctggcgcatgagttctatcgccaacctgcattctccgattcctcttggcgcccgttttctgctgtgtgaagggtcggccgtccattgttccacttcctcgatgtagctgatgaaatcttctaactcgtaatgcagacctaattcgctcaggcgattgttggggccgagaatagcgtcgcccaacgccacgaggtagtccagactgacgaatcgggccatcatgaaccatgtacataccggatcggtgcagtagatgccaggagacacttcgactcggtgaatcgggacgttcatggtgtaataggcgacgccgtaccggtgtttttccgcataccgcatcccccttgaatcggcaatgatttgcagatacctgtctttttcccaacgactgtatgccgctcgaagccatggcgtggtgatgcccagcagctccaaagccgtgagcagtccgaaggtcgcgtccatcttgcgttcgttcaggaaggcgctgcaccgtccgctcatgcgtatctgagtctgctctacatcggccatcataccgtgcggttttttgttgatttcgttggtaatcatgcatccagccaatcacggtaggagtcgcatgtacaccattgcgggccattgtggtcggagaacagcgtgtcggtaaacgatgtggataaccttatccctccttatccacatgtggacgacgtacactacacttccctaatccctacctcttcatcctttttccctcccttttccctcttcttcccctcttcttctccttacgggatgtcgtcaactcttacgggatgtcacgcccaaagtatcaacccccaaaaaaccttggaaatcaatcaccaatcgattgctctagggagctgatatccaaaaactgacatcccgtaagagttgacgacatcccgtaagctatttcagagtaaataggccatacatctagagccctctctacagcccgttctccgcagcacaccccttacaccgcacctccaaccctctacttagcacctccactcctcctacgcagcaccccaaccccctacgcagccaaactcccggcgcatctggaacgttcagggccaaaaatccaaacgccacactcgatcttgcctacactagaagcgatagcaacgataactcaaagaaggagcaccaatgccagtcattcacacgcatgtttccgtccccaccaccgccgagcagcgcgacgcgctcaagaccgcgttcggccaggccatccccgccgtccccggcaagtccgagggctggctcatgtgcctgttcgaaagtgatgtcccgatgtacttcggcggcacgaacgacgccccggccgcctatgtcgaggtgaacgtcttcggcagctcggtcccgaagtctgcgtggcagaagctcacgcccgcgatcatggacgcgctgcaagacaccttgcagatccccgccgaccgcacctacatccgctacaccgccaccccggactggggctggaacggcggcaatttctaaagtcccgccctgcaaacgcagaaagccccaggcaagtctacttgagacctgacatcccgtaatggatggcgacatcccgtaagagttggtgacatcccgtaagggatttgctgctcagacgatcttcggcatcggggtggtcaggctcgtcgtcaggttcacctgcacgagaccggcacccgaatgcacctccaccttcttgagtgtcacggtgcgctcgtcggcgggggcggcgtcgttgtcggtcatcgtggccggcgacttcacggccaccagcgcgagatcggcgaagtcgatgccggcatcggcgcacaggcgctccgcctcggcctcggactcggcgaaaccagccttgtcaatcacgcggtctgccggcacaccgtacgcattgccgcacacgaactcgatcttctcgcgcagcgactcgcccttgaagctcttcggccgctcgggcagcgcctcgtcggaaaccgcctcgacgaacgcgtcgagctgcggtgcgagcgcctcgccgccatcgcggaacagattgcccacaatcgggtcgcggaagccaagttcctccgcagtctcgcgcaaggccggaatctggtcatcctcgccctcccacagattaataagcgggaaggtggggatgccgagcttctccaagcgatcgacatggaacgggtagcgccactgcagggcaggatcgtcgcgccaggtggtcgcgcgggtgaccacaaccgcggcactcggccactgcgcgccatattcacggcatgcgatgtcgagccacttctgcgcgccggcgtcggcaccgtagccggcctcgacgatcaccacgtcgtgcagcgcgcacgccatctcaacggaaacaagcgtaggaatgccaatggagacgttcgcgaacgggccgccgtgcacgtacaccggcgagccgttcacggtctcggttttcgcgggcttcacggcgtcggtgagaatgttcgtgatgcgccacaagtcaatgaattcgccgaaggtcacgggcttgccgtccttcgtgccggcaatcatatgcgccacgcggtctgcgatctcctccatggagcgcgacagcacgacgatctgcatgagctcgcaggtcggcgtgagcaccacgcgctcgggaacattgcccttgccgcggtccacggtaatctggcgcagcgagcgcgacggcacttcggagacgcgcggcacgagcaccgtgtcgagcaagccgtcgtcaatagccttctcggcgaaggacacgagcagattctgcgcggcctcgatcgaccccatctcgccgcacagaccccagtcgatgagctcgggatgcgtgagcgacgccttgccgccgccggaggcaccgcccttcgaaccggctgcggtgatgcccatgctcggctggcgaagaacggcggccgcatcgatgccacgctcgttgagcgcgtcgatgagcgcgatcgtcgtcgtggtcttgccctcgccacgtgatgccttgagcggggtatccgccgtcacgagcaccaccttgccctgcttgcgcggtgcgtcggggttgttcttcagggagtcgaggtaaccgaaagcgtcgatcttgtctaccaatccgtaaggcttggtgaagttctcgataagcgtcactacacgttcctttctgcgggatttgctgccctttcaacatatcagcacggcatggcgcacgaggcgagcgtgtcactgtgcgaacgcggcggcactgcgctgggtgtcacctcaccaatctgccgatgtcacgcaagccaattaccgtgccgtgccgtgtgggaatcgtctcctcgccgccatacaccacgaaacggcgctccgtgggcacacccatcgcctctgcgatgtcatccagcgtttcgaaatacttcggacggtacgtggccgacgatttgatctcgatcacgaaatagggattccccccacgctcaataatgaggtcgacctctttttggccgctgtcacgccaataatagagtttcggctccttcccctgcgcctggtattgcttgactatttcgagcacaaccgcgttctcgaacaacgccccgcgacactggctcgcgaacagctggtccgcgctctcaatgccaagcagattcgccgccaaaccggtgtcatagaaatacagtttcgcagatttcaccagtcgtttgccatagttgcggtagtacggctgcagttggaaagcgatgaagctcgcgttgagtatggaaagccagttgcgaatggtggcgctgtccacatcggcttcgtcggcaaggtgagacacgttcatcacctcacctatacgaagtgcggcgagcgtaaggaatctgttgaaggagtctattttcttcacgccgagctcagcacgcacatcgcggtcaatgtatgtggcgacatagccggggtagaaatctgccggcgtagccaacgaggagtaaagacgcgggtatccgccacggaatacgaactcgtcgttggacggggtttcgccagcgtgcgtcagctccgtgtaagaaagcggaagcagatgcagaatggccacacgacccgccagggactgtgagatgctattgagcagcaggaagttctgcgatccggaaagaatgaactgcccgggctcattgcgctcgtccattacgcgttgcatgtacgagaagagctcaggcacgcgctgtacctcgtcgagaatcacatggttcgagtaacgctgcaggaagctgcgcgggtcgtcgtgcgccaattcacgcatatcgatgtcttccaaggaaacgtagtcgtagtcgggaaaggcttcccgcaccaatgtcgacttcccgctttgcctcggaccagtgagcgtcaccgcagggtaggctcgggctcgttcgagcagcatcggctccagttcacgtggaatcaacggcatgtcaacctcccggcgcccactcagcaatttacacgaatcatattcggcaatatgcatacagtatactcggcaatttgcatgatgactactcggcaatctgcacgaatcgcatttcccttgtgcatgaatctgctttggtgtgacgttttttgctttggtgtgacggtcggccgagctgcccgcattccgaaatggcggaattccgccattcgcagttcggctctctggaaggcaccgtcacaccaaagcggaaagcgccacaccaaagcgttctccggggccgctcgcctcccaacctcacgactgccgtggggttgggaggcgagcgggagggatggcgcaggagaggatcagttgtcggacatcgcgaagtggttcttcatcgcgaggctcgacgtgaacagcgcggagtcgagcagcttctcggtctccttcttgagtttgcgcgccaaatcgtcgttcgccgtggccagcacctcgcgcacctccgggttgcgcacggcggtgatgatctcatccgggctcatcggctgcacgtcttccacgagctcgtcttcggcgaactcggcgttggcctcgcgctcacgggacgcggcctcgagcacggctgtgccgcccaatctattcacctgctcgtcggcagcacgcaccatggcatggccaagcgcgccgactttctgctggtaggtctccacggcgttcgcggtctcggcgaactgcgcgtcgcacagcacgccgatcaatctgttcgcccagtagaaattctcggaggtcacgcgcgtggtcgtgtcgcgcaggtaggcgggcgtgtcgtcgacgttcgggaagaacgggaccatcgcgttgaacggattcgaaccataggcaagccactgcaccgcgcggttgacctgcgggcggtacgggcgaatctgcatgacggccagatgattcgtgcgattgatgccgatcgggcggaagcgcgtgcgcgacgccgcgtcaccgagcgaaccgtacgggtcgaacggggtctcctggtagtgtgagctcagaatgtacttcacatcttccatcgagatcttgcggtcgggctgacggcaccacggaatgtcgtcggaattcggcttgtggtcggcgtccgggccgtcccacacctcgtcgaacggattgaaatagcgctgcatataccacgcgcgcggcgtgttgtacacatggtcggagtcggagtgcgagccgaacgcgtcgcgcggcgagaacggcatggacccctccaccgcgagatcgagatgattccgctcgatgaagtcgcgcatgtcggcactgcacatgtagttgacctgctcgccgatgccgtcttcgacgtcgaactcgtcaatgccgagctgattcggcatcgtcacgtagcagtcatctggcacgcggcgtgcgatccagtggtggccgcctactgtctcgagccaccagatctcgttcgcatcgctgaatgcgacgccgttcatctcgtacgtgccatactcctcgagcagcgcgcccaggcgtgcgacgccctcgcgcgcggtcttgacatacggcagcacgatggtgaggaagtcctcctcgccaatgccgccggcgacctcaggctcgtagtccgcgtcgcccggcttgccttgcgctggcacatactcgacgagcgggtcggcaccgagcacgcgctcgttcgtcgtgagcgtctcggtggcgctcatcgccacgttcgcttcgttcacgccggcttcgccccagatcccctgcttgcggtccgcgttcggcacactcgaatattgcagcggatcatcgggcagctcgatctgcacatgcgagatcaccgcgcggtaattgcgcggctggtcctgcggcttcacaatgatgaactgcttcgggtcgaattcgccgttgcagctgtcttcattgcgcgcgatgatcgtcgacccgtcgtaactcgcgtctctgcctactagcagtgtggtgcagcccatgattctcctcagctcgtctgttgtttttcgaacattgtagaagtttacagattctccacacatgcaccacccatgatgcgatatgcgaagttcatatgctgagattgtcgcagttcctcggcgattcgtcagccccgcattctcacccccggctctctagggcatttttgaggccccagcttctcttaacccctccccggcctttcttaaccctccccggcctctcttaaccccttacgggatgtcgttatttcttacgggatgtcttgccccaagtagacctgtgtgaaaatgttcgcaatgacgttatttttgtcgtaatgcaccgagccgcatgcgccattttgatagattttgagcattttaatatattacgagagaaagaaaacatcccgtagggaataaagacatcccgtaaggaataagaatatggaatagtgagaaggaataagaaacagcccagcctttgatgccggaaagaggccataggttgggctggattgttgggagcagaccgatttagaagtcggccatgctgaaggcgtccttcatgttcacgctcgtggcctgcaggcactgggcgagaatcgtctgggtctgggccttgagctgcttggccatgttctcgttggcggcggccagcacctcgcgggtcttctcatcgcgcgtggccttcaccacgtctgcgggcttcatcggctccacgtcggcgggcagcgcctcctgctcgtcctcgcgttcgcgggcggcggcgtcgcgcgtgtctttgccaccgagacgggcgagctgctcgtcggtggcgaagaccatctgatgcccaagcgcggcaacggtctgcttgtagtgggcgatcggctcggcggtgccggagtaatccgagtcacccagcacggcgaggaatctgctcgcccagtaataactgtcgagcgtgacctccggcgtcgtgttgctcacgtagtccggcatcgcgtcgacgttcgcgaagaacggcacggtggcattgaacggggtggcggcgaacgtgatccagtggattgcgcgatcggcttgtggagcgtacgggcgaatctgcatgatcgagcgttcgcaggtgcggttgatgccggcaggacgatacaggtgacgggtcgcctcggtgccgagcttgccgtacgggtcgaacttcgtgccctggtagtgcatggcgagcgcgtagtcgacgtcttcgatcgtaatcttgtggtcgggctggcggcaccacggaatgtcgtcgctggatggcgtcaggtcagcgtccgggccctcccacgtctcgtcgagcggattgaagtagcgctcgatcatccacgcgcgcggtgtgttgtacacatggtccatgtcggagtgcgagccgaacgcgtcgcgcgggtcgaactggccttcgagcgcatagtcgacgtcgaggtgatgcatgcgcatgaattcgcgcagatcggcggagcacatgtagtcgcgctgctcgccgaacgcatcttcgaaatcgaactcgtcgatgcccaggcggttcggattcaccacgtagcagtcatccggcacgcggcgcgcgatccaatgatgaccgcccaccgtctcgatccaccacacctcatgcgaatcggagaagccaatgccgttgctttcgtacgtgccatattcctcgagcagcgagcccaagcgctccacgccctcgcgagcggtgtgaatgtacggcagcacgattgtgacgagatcctcctcgccaatgccgccggccactgcgggcacgtaattcgcgtcgccgggcttgccgatcgccggcgtgtacggcacgagcgggtctgcgccgagcgcgcgcgcgttcgacgtgatcgtctcggtggccgtcatcgccacgttcgcctcgttgataccggcctcgccccacacgccgtcgctcgtgaacgaattcggggtctcggaatactgcagcggatcgtcgggcagctcgatcgtcaggtgaccgttcacgcttgtgtaggtgcgcggctggtcttcaggccgcacgatgatgagcttcttgttgttgaacgagccgggctcgtcgtcttcattgcgcgcgatgatcgtcgacccgtcataactcgcgccgcggcccaccagaattgtagtgcatgccattttgcttcctcgatttcacgaattggtttctcttcgctcctttagtgttctaccgcgctttgccgcgcaccggcagtgctgggcggccaattattccgtaggtggatatgtgggcgaatatgcgggcgcctatgtggtttgcagatcgccccattcacggcctgttatacggaagactccgtgaaacgaaccactgcacgacatatctgcggcccgttttacggaagcttccgtgaaatatgccgcagattgccctccccgcggtctgttacgcggaaggttccgaaagctgggccgcaaatcgccccctccgcggtcaatcgcgcggatgcttccgcaagacatgccgccaggcagcacttctgcggtcgattacacggaaggttccgaaagatacgccacagattgactcccccatggcctggcatacggaagcatccgtaaggcggaccgccaatcagctaatctgcggtcagtcatacggaagcatccgaaaaacgaaccgcggaatgccactcccgcgtaccgttacacggaagcttccgaaagaacgaccaagaaactgacccaccgcggcacagcatacggaaaactccgcaaaacagaccgcagagggacctcactgcggcataacgcacggatgcttccgaaaaacggactgcgaggcagagctcagcacttgccgatcagcgtgatgccgccgccgtcgacgacctgcgaatgctcgaggccgtgcagcatctcgttgagccagaagccctgttcgagtccggcgatcggcgaggtggtgccccagatctgcagtacataaccgtggtccttgtccggtggctgcgggccggtgtagtgtgcgacgagctgcagattccgctgatcctgcccgtacagcggcgacgcctgcgaattgcggccctgcacggcctccgggatcatcgcggtgacgcggcgcgagaaatccggcggaatctgcaaggcgtgcgcgtcggacgggtcgaacatgagcgcggcgaccggcagattcgccatggtccagtggatccattcgaatccgcataccggaatggaatccgggtcgctgaattcccagtgcaaatacttggcggccgggttgagatggtcgatgtagaacgggaacgagacgcagggcacgccgtccacgcgcgcgtcatcgggcgcgttcttggcatactgttcggggatggtgttgaaatctgcggaaactaacatagttccagtatcgcgcaccgtgtcgcccgtgcgtttcttgttcacgccgagcacgcgcgcattgaacggcagtttgcgcagacatttccgcgtaaactgccatttccagattacagattggcggtttccacggaagcctccgaacgccatgccattcccataacgcagtacgctagcgacgttcgggaagcagcgcgcagaacagcgcttcgatgtcgagcagcgcattgccgttgcccgcgatgcgccggcgtgcggtggagatggcgtccatgcgcgcgagggtctgctcgcgggtgagctgcgcggacagctcggctatggcgtcgcggttctcgatgttgatgagccccaccgacccctcggcgtcgttctgaaacacggcgacgtcgcggtagatgctggcgatcgtggtgaacgcgcggtcgagcacatcgcgggtcatgcgcgtggcatgccgcttgatgtcgtctttcttggcgagcgcggtgtatgcgcggcgaagatcggcgggaaccgtctcgtcgggcgagagtccgttgagtttgcgaaactccgcctgccgctccccagccgcctgctcggcgcgttcgttcgcctgctcctgcgcggacccatacagttcgcccgcgaagacgaccgcctgcgatgcgcgggtcatcttcagcacgttgttcacaagctggtcgcgcgagcgcagcacgctcgggtatcgcgcgtaaagccgcgcgatgtcgagattcccctcgcacagccgcgcaatgcgcactgccgtttcatgtgaaacagggcgcggttcgggagcgggagccggcttgggcgccttcgcggatttgccggagcgcgccgccttcgcgccagcccggccgccgaccgccttcgcccgcgcgcgctcgcgcttcgtcgggtcttcgagcacgcgcacctcgcgttccagccaggtcgcgatctcgtcggccaccggcacgccaagcgtgacgagccgcgtgcgcgagcggatcgtgggcagcacatcctgcgcgctcggcgcacacagcagccagatcgtgtgcgcggagggctcctcgatctccttgagcagcacgttcgtcgtgcgctcgagcatgcgttcggtgttctcgatgatgatgattcgccaaggcgcggtgctcggcatctgctcgctgagcgtgaccagatcacgcacctcgtcgatgccgatcgtcaccttgtcggtggagagtgtgacgacgtcggggaagcggtctgcgagaatctgcgaggtgatcttcgtcggcagctcgccctcgccgtggtcggggctctccaacgcggcggcgaacgcgcgcgcgacctgcatggtgcccgagccggccggcccgcagatcagccacgactgcgccacgccgcgcccgtcaccctcggcgacgcgcctgagttcctcgacaaccttcggctgccctacgattgcatcccacacactcataggtgttactcaagcagattcgcgacgtcgtcgcaaatcagcgcggcgatttcccccacggactgctgtgcgtcgatcacgcagaagcgttgcggctgcacggccgcgagctcgaggaacgccgtgcgcgtgcgctgctggaagtcgtcgccggcggattccatgcggtcttcggcgtgctcgaggcgcgtgtgcgaggcgcgcgggtcgatgtcgagcaagtaggtgcgcgcgggcagcagattgttcgtggcccacatgcttaaggttcgaatgtcgtcggcggtgagctcgcggccaccggactggtaggcgagcgaggagtcgaggtaacggtcggtgatgacgacggcaccgcgctcgagtgccgggcggatgacctcgctcacgtgctgggcgcggtcggcggcgaacagcagcgcctcggtgcgcggggagatctcctcgtcgggattcgtggtgagcagcatggcgcggatctgcgtgccgagcgcggtgccgcccggctcgcgcgtgacaaccacctcgcggccgagcgcacgcagatagtccgcgagcagattcacctgcgtcgtcttgccggcgccgtccacgccttcgaacgaaatgaacagtcctgcgcccatcgcctctccctatctaacgctggcatctgccacgctggtgcctgcttattttgatacctgctaccctgatagctgctacgggccagactatccgttacgggctaccaccgcccttacgggccagcaatttgcttacgggccggcagtttctgttacgggctagggaaaatgagcggggtacgcccgtatcggttacacaaaaccgccattgttcaacagtctatatcccaaatagagaggttggccctagcccgtaacagaaactgccggcccgtaagagacatcttggcccgtaaggggtgtcctagcccgcagcaggctggcccgtaacaagctggcccgtaacagggagagacatcccgtagcagttggtgacatcccgtagcagctgacgacatcccgtaagagataacagtgcgtacgggatgtcaccaactcttacgggatgtcgtcaatgcttacgggatgtcacggccaaagtattcgaggcatcaaaccttggaaaatggccattgctcttgtcgttcaaagggtaaggggtcaaaaaactgacatcccgtaagagttgacgacatcccgtaaggattaaacttcagacgacaccggcgcaaaggatgcgtcagggttgccgacatcccgtaaggaataaatgcgccatccccacgggccagggacgcctatggctacttggctgggacgacgggcggccgcttgaagccttcgttcgcctccaaatactccacgtcggccttcaccgtggcggccgaggagccgatctccttcgcgatgcgcgtgttcgcccagccctgctcggccagctcgcgcacctgcttgcggcgcctgtcgcgggctgtctcagtggcggacttcttcggcgcggacttcctgcccttcgccgtgcccttccccgtcgatttcgcgctggccttgcccttgcggccacgcctcttgctcggcccggcggcgcgcttctcggcgagcaggcggaacgcgtcctcggcggagatggtcttcggatcgtactgcttgggcagcgagcggttcgtctcgccgtcggtgatgtacgcgccgtagaatccttccttgatgctcacctcgcgcttcgactccgggtcgggcccgagcgtgcgcagcggcggcttcgcggcaccgcgcccacgaccgtacttcggctgcgcgaacaatgcctgcgcatgggtctcgtcaacggtgaagatcgcatcttcagactcgagcgaacgcgtttccgaagcgccgccgtccgcgcgcgtcttcgtcaggtacgggccgtagcggccgttgctcgcgctgatcgtgaccgagaccgtctcaccggtcttcgcatccacctcgtcatacgtgcacacggtgcgcggcaggctcagcagacgcagcgcgtcgtcgagcgtgaccgtctccggcttcatgctcttgaacagcgacgccatcttcggcttcggctccgcggccttcttcttgccggtcggggcgctttcgtgtgcagattccggcgccaccaacgccacatacggaccgaatctgccgttgcgcacctcaacggtgcctccggtggccggatcggtgcccagcacacgcggaccgcccgcattgctggcgatgagcttgcgtgcctcgcccaccgtgagctcgtcgggggcgatggtgtcgggaatcgaggcgcgcttcggattgccttcggcgtccagatccttcgtgtcttccaaatatgggccatagcgccccacgcgcacatggatgccgtcgccgatcggaatcgtgttgatctcacgggcgtcgatctcgccgagctgcgcgacctgacgttgcaggccctcatgtgcctcgtcggccgaacgggcagaatccgcgcccgaaccgaaatagaactgggtgagccattcgcgaccggtctcattgccgtgcgcgatctggtcgagaccgttctccatatctgcggtgaactggtagtccacgtacttggggaacttcgtctcgagcagcctggtcacggcgaaggcgagccagctggggatcagcgcacgcccgcgctcgtacacatacccgcggtcgatgatcgtcgagatgatgttcgcgtacgtcgacggacggccgatctccttggcctccaaggtcttcacaagcgacgcttcggtgtagcgtgccggcggctgcgtctcatggccgtctgcaagcacgctcttcgccggcagttcggcgctctcggcgagcggcggcagcgacgcgctctcctcgcccttcttgcccgagccgccgcgctcgccggtcacgcgcatgaagccggggaattcgatcaccgtgcccgacgactggaacgtcgcctcgccgagtccgcccgcagatgccgcaaagcgcgcggtggcggtggaaccggtggcatcggccatctgcgaggcgagcgtgcgctgccagatcagcgtgtacagcttgagctgatcgggcggcaacgtggcgagctgcgagggatcgcggaagtgcgagccggcggggcgaatgcactcgtgcgcctcctgcgcgcccgcggtcttcgtcgcatactgcttgggcttttcggaaaggtactgtgagccgaagttcttcgacacgctctcgcgcgccgcttcgatcgcctcatgcgacagcgtcaccgagtcggtgcgcatataggtgatgtacccgttctcgtacagactctgggccgcgcgcatcgtctgccgtgagctcatgccgagtctgttgccggcggcctgctgcatggtcgacgtggtgaacggcggctgcgggcgcctgcgatacggcttcttctccaccgagatcacgcggaagcgggcgtcggcgagcgcgtcggcaaggtcaccggcctgcgattcgcccagctgcaccacgccatccgtgcgcgcggcgtcggtgagcgtgccgtccgacttgaaatccttggacgtggccagacgagtgccattgagcgcaatcatgcgcgattcgaaatcggtcggctcgccgagcgcgtccggggcgcacagcgtggcgacgacatcccagtacggcgcgcgcacgaacgccatacgctcgcgttcgcgctccacaatgaggcgcgtggccaccgactgcacacggccggcggacaggcccggccccaccttgcgccacagcaccggcgacagctcatagccgtacaggcggtcgagcacgcggcgggtctcctgtgcgtcgaccatgttgttgtccacttcgcgcgtgtgttcgagcgacgcgcggatcgcctccggcgtgatctcgtggaacaccatgcgcttgaccggaaccttcggcttgagcgtctgcacgagatgccatgcgatcgcctcgccttcgcgatcctcgtcggtggcgaggtagagctcgctggcattgcgcagcgcggaacgcagttcggagacggtcttcttcttctccgggccgactatatagtacggcttgaacccgtcgttcacatccacgccgaacttgccgaacttcgccttctcgtccgccggcacctggcttggctgtgcgaggtcgcgaatatggcccaccgacgccagaacggtgtagccgtccccgagatacccgccgatcttcttcgccttggcgggagactccactatgacgagcttgctgccggtggtcatgatcgctctccttactttccctgacgagtccacatactactcacgttccacacaacttttgcgcgcggagcgtgttttcgagctattgcgccccatatggccctcacaccttccctctgctacgggatgttttatttcctttggaatgaaaagtagattatcaaaaataacacattttgctgattactaagggaattaacaacaaaattactgtcattttcgaacaagtccacttgagtgcagacatcccgtagcagatagtgacatcccataagagatgacgacatcccgtaagcaataggggcggtagggcggcacggcacaaggacggcggcaccgcgcaatcagcggcgcggaggcgcgggcggggcgccgatctggcccagacgtgtgagcggcgacgcagtgagctggcgcacggccagcacagcgccgacgacgagcgcgttcaccgcgatcacgagcacgccggcggacatgcacgcgccgcccgtcgaccaggcgacgccgtattcgagtccggggaaaatctgccagatgatgtagccggcgtaggcgaaaccgcagatgccgagcgtgatgagcacggttgaggcaatctgcacgctggcggacgagacgcgcttgccggggcggtccatgccgctcctgcgcgtgaacagcaacatgagcatcgcgagcgcgcccaccaggaacacggccatgagcacgtcgcaggggcggtgccatttgtctgcgatcacaaagacgcccacgagcatggagtaggcggcggcgaacagggcgcaggcggcgcgccacgcccggggcaccgcgcagacgagcatgagtccggcggtgatggcgagcatcgtgtgtccgctgggcgcggagttcgcggtggacgaatgaatctgcataagcagtggccgagggagtgccggtttgagcacgcgcgcgcaggcgaaactcacggcggcgaatgcgacgagctggccagcgagccaccaacggcgccgcaacagcgcgacgaacacggcgatggcgccgagcgagatgctcacgctgatcacgaccacggaatcggtgagtcccagattatgcctgagcagccactgcggcgtgtagttcgcgaaattgccgatgacgaggtcttcatagccttggcctttgagcgtgtgcacaccgagccgatacgagccgaacgcgagcagtgcgaacacgagcgcgatcaccccacacaggatgcggctcgagatgcgcgggcggaccatgagcggatcgacctgcgtgagcccggcttcgatttgggcttgcagatcctccggcgaattcttggccgtgcgctcgctttcgctttcagacagcggcacgaagccacgcgcgcgggcggcgtcaatctgtgcggcgatacgcgggtcctgggtctgcgagtccagattgtcttcgcgcacttccgcacgctcctgcagcacgctccactgtgtgtcgtctgcgggagtggagtgtgtgggtgcggatggcgcgggtgacgcggagtgcggcgcgcgctgtgcattggtgttcgtctcgtcgtgctcgctcatgctattcacgatacgtgcagaactgaacagtgagcagatatgagcggatatgaaaaacctccgcgcacccaccagaggccacttacccttgctgcattcctgccctggggggattgggtgacatagtgccacgcggaggcgtaagccagtgtacaccacccctgccccaatgccaacccaacgtgtacgtccgcacccgtctgcgtaaatccgtctgcgtaaatccgtctgcgtaaaaagggacagatggaggcccgcagatgtcccaaattacgcaaaggagcgcaaaggaggaggaggagaagaagaagaagaaggagaattgtagggaaaacaaaagggtgacgcgtaggcgtcaccctttccacggttgcataggccacaggaagccgaatcaggccttccacacgtccttgccggcggccttggcggctgcgacatcggcgttgagctcctcctcgttggcttcgacgtcgcccttgatgaaggcttcgacgagctgacgggcctcggtgtcctcatgctggacggccggggacttcatgaagtaggaggacggcgcgagcaccgggccggccagaccgcggtcgagggcgatcttggcggcgcgcacggcgtcgatcacgatgccggcggagttcggcgaatcccacacctgcagcttgtattcgaggctcagcgggacatcgccgaaggtcgtgccctcgaggcgcacgaatgcgaacttgcgatcgtcgagccaggccacatagtcggacggaccgatgtgcacgttgtgcggatccatctcatggggcaccacggaggtgacggcgcgcgtcttcgagatcttcttggactcgaggcgcgaacgctgcagcatgttcatgaagtccatgttgccgcccacattgagctggtaggtgcggtcgagacgcacaccacggtcttcgaacaggcgggcgagcacacggtgcgtgatcgtggcgccgacctggctcttgatgtcgtcgccgatgatcggcacgccggcatcgcggaacttctgggcccactcagggtcggaggcgatgaacacgggcaggcagttgacgaaggccacgcccgcatccatggcggcctgggcgtaggccttgtcggcctcctcggaacccaccggcaggtaggagacgagtacgtcgaccttcttgtcgcgcagcacctgggccacgtccaccggctcctcgtcgctctcggtgatcatctcgcggtagtattcgccgagaccgtcgtgggtcggtccacgcagcacctcgacgccgaggttcgggacatccgcgaacttgatcgtgttgttctgcgaggcgccgatcgcttcggagaggtccttgccaaccttgtcggcatcaacgtcgaaggcggtcacgaattcgatgtcgcgaacgcggtatccgccgaaattgttgtgcatgaggccgggaatcttgtcttcgtccttggtgtccttgtaatactcgacaccctgcaccagtgacgaggcgcaattacccacaccggcaatagccacgcgaatgctcattgaaacgactcctctaataatctgtgttactcgtgagcgattttccgcctttaagcataccttcttatccccacgatgcaattcgagagatatataccgaagatagtcggcatgctggaaaacgtcgccaaagctacgctttcgtaagttcgcgctcagattacagttcctcgccagccagacacccgccatgcaatctgttgcccggccggcatctcaaaaccgcacaccgcgggttggcttgtgcagattcctcccgcaatcttgagttttttcagggtctttgactaccgtggaacgcatggtctaccaagcacgtaccgtcagctcaagctcaagctcgccgcgcgccgcgcacaaggcgtccacgtcgcaccgcgcgcccaagcgcgggcagaacgccccgaaaggcccgaagaagcgcacgaaccgcaaaaagggactctggtggaagattctgctcggcgtgctcggcggtctgctggcgattggcatcggcctgttcacctacctgtatgtgaccaccgacattccgcagccggagaaggtcgccatcgccgagaagaccacggtctactacaacgacggcaccaccgagatcggctcgttctccgagcagaaccgcgagatcatagattgctccgtgctgccggactacgtgggcaacgcgatcgtcgcctccgaagaccgctcgttctaccgcaacggcggcattgacatcatgggcatggcgcgcgctctgtacaacaatctgaccacgggatcgcggcagggcggctccacgatcacgcagcagtatgcggaacggtattatctgggcgacaccacctcgtattcgggcaagattcgcgaggccatactcgcgatgaagatcgcgaattcgcaggacaagcagcaggtgctgtgcaactacatgaacacgatctacctgggccgcggcgcatacggcatacaggcggcggcgaaagcgtacttcggcaaggaggcgaaagacctcaccgtggacgaggcggcgatgatcgccggcatcatcccggcaccgagcatgtgggacccggcggtgaacgaggcgcaggccaagagcagattcacgcgcgtgatcggcatcatgcgcgaagacggctacatcaccggccaacaggccagcgaggcgaagttccccgagacgaagccagtgtcggtgagcaacgacctggccgggccgaacggctacctgctcaccaccgtggagaacgagctcgtggcgagcaaggcgttcaccaaagacgagctcgagaccggcggatacaagatcgtgagcacgctcgacccgaacatgcagaagatcatgcagacggtgggagatgaccggccggaaggcatgccggagagcattcaggtgggcggcatcgcgctcgaccagaagaccggctcggtgaaggcgatctacggcggcagcgactacctcaagcaccagctcaacaacgccacgcaggcgaacttccagccgggctccaccatgaagcccttcggtctgctcggcgcagcaatggacgacgtgaacttcaacacgatgttcaacggcaattcgcccgaacgcttcgaaacgacgccgggcacgtgggcagaggtgccgaacgcgctcaacatgagctggggcacgatcaacctcaagcaggcgaccgcgaactcggtgaacacggtgttcatgaacgtgaaccagcatctgacgccgaagaaattcgcccagatcgcgcatgatgcgggcatcagcggcgacattcaggaagacacgctctacaacatcctcggcatcaactcgctcaccgtgtgggacctcgcgcaggggcactcgacgatcgcgaacgacggcacgaagaacacgctgcacattgtcgaccgcgtgctcaagggcgacaaggagatgtacaagccggacctcggcacgaagcaggtgttcgacgcgaacgactgccagctcgtgcagaacgcgatgctcggcaccacgcaatacggcaccgcggcgggcacggcggcgaggctcggccgtcaggtcgccggcaagtcgggcacggcgaacgacgagacggcggcctccttcgtgggctacacgccgtcgctgatgaacgtgtgggcaatctggaatccgggtgagaacggcgaatcgcagatcgtgccggaattcgcgggctacggcgtgagctcgaccggctacccgtcgcatctgttcaccgagttcatggcgcaggcgctcgccgggcagccggcggagaccttcgcgacgccggtcgacaacggcaagattggcggcccgaacggcgactggggtctgggcggccagcggtacgtgccgagcacgaacaatggcacgcagcaacagcagcagaacgagcagcagcagaccgcacccgagaacacgaagaccccggagcagccgcaacccgggaacgacaacaccaacggcaatggcgggggtgaaaccggcggcaaccccagtgacaacaacggcggttcgaattccggcgattccgggaactccggcaatcagaacggcaacaccagcggcaacaacggcggcaacaacggcagcaacaacggcagcaacaacggcagcaacaacagtggttcgaattccggcgattccgggaactccggcaatcagaacggcaacaccggcggcaacaacggcagccagaataacaccggaaacggcgagcagacgcagcgatagcggagccacctatgcgaaagccgcgggcacaacacccgcggctttcgcataggctcgcatgcctattactcacatgccgacggccggcatggcgtattcgcctgccggccgccagtgcagcatcaacgcaacggcagcgccgcaacgtcagcggttggagcggttgatcgccgagatgatcgccttgagcgagctcgtgatgatcgacgagtcgatgcccacgccccacacgacgcgcttctcctcgtcttcctggccgacctcgcactgcacgtaggaggcggcgcgcgcgtccgagccgacgcccatcgtatgctccgcgtaatcgagcacggacgccacgacgccgaagctcttgagcgcgtcgaggaacgcggcgatcgggccgttgccggtgccctcgatctcgcgcgtcacctcgggctcgcggcccacgttgatgccgcggtcgagcacggtggcggtcaggcgcgtgtcggaaccgtcctcacccgacgacatgctcaccttgagcagcttgagacggccccactggtcgagcgtctcgtcatgcgtgtcggcgaccacctcgccggcctcgatcgcgccggattcctcgacgggcaagtactcgtctttgaacagatgccagatgtcgccgtccttgacttccttcttcgtggcgtcggcatgctgctgcaccaccttctcgaattccacctgcagcttcttcggcaggtcgagattgtgattcgccttgagcaggtaggccatgccgcccttgcctgactgcgagttcacgcgaatgatcgcctcgtacgaacggccgatgtccttcgggtcgatcggcaggtagggcacgagccacacgaagttctccacgtccacgccggccatctccgcggcgatctcacgcgcttcgagccccttcttgatcgcgtcctggtgcgagccggagaacgcggtgaacacgaagttgccggcatacgggtggcgctcggagatcttgatctgattgcagtattcgacggtcttgcgaatgcccggcatgtcggagagatcgagctgtgggtcaatgccctgcgtgagcagattcaggcccagcgtgacgagatcgacgttgccggtgcgctcgccgttgccgagcaggcagccttcgatgcggtccgcgccggcgagcataccgagttcggcagcggcgacgcccatgccctcgtcgttgtgcgggtggagcgagagcaccacggcatcgcggtcgcgcagattattggaaacgtactccacttcgtctgcgaacacgttcggcgtggtcatctccaccgtcgcgggcagattgatgatcatcggatgcccgggcgtcggcttgatcacgtcgatcaccgcattgcacacctccaccgcgtactccggctcggttccagtgaacgattccggcgaatactcgtagtacaggtcgatgccctcggcgtcgccctcgagttccttgcacaggtgcgcggcatcggtggcgagcttcttgatgcccgcgcggtctttgcggaacacgacctcgcgctgcagcacggagacggagttgtagaagtgtacaatggcgcgcttgcaaccgcgcaggcattcgtaagtcttgcgaatgaggtgctcacgggcctgcgtgagcacgacgattgtcacgtcgtcgggaatgagctcgcgctcgatgagcaagcgaatgaagtcgtaatcggtctccgaagcgctcgggaagccgacttcgatctccttgaatcccatgtcgacgagcatggtccagaaccgcagcttgcgctcggaatccatcgggttcacgagtgcctggttgccgtcgcgcagatccaccgagcaccagcgcggcgccctgtgcagccgcttgcccggccatgtgcgctccgggtagtcgaatggcacctgcttgtcgtatgccacatacttggtgtacggcatatcgctcggcttctgcggggcgccaatgtaccgtgccggaggcagcagcgggtcattgttccccccattggatgccgcggcaacggcagcgagatcaaacaccgaagattgaccctgacccatcttctcctccttcgagagtgcaaaattttcagatttcgtgacgcgcacacgcgcgtaaacaataaccatatacgcgctagcaagaaaggggcttgcgacagtccgtatttcggccatcccaagcagggattttacaaacattgcatacaattcgcgccgcgctgtgctgcgcggcactgcgcggcactccctgcggcacaagtttgcggactgtggcacggtttacggaaggttccgtggaatctgccgtttgcagacttctccgcggcacatctcacggaggcttccgaaagacagaccaccaaaccacactgccacggcacaacgtacggagacttccgaaaactatgccattccggggcccctctccggcatatctcacggaagcttccgtaaaacatgccacaaaggcatctgaaaatggcatcgtatacggaagcatccgagaatctgaccgcagaagctaccaaaaacagcacggcgcacggaagtctccgtaaaatatgccatccctggatctctccgcaacgcaacgcacggagacttcctcaaaatacgccgcgctcagccgcgcccttcgatgagactcacaccgcggcgcgcgatgcagtatgcattgccgagccaggtgtggcgcgagttcggccagacggcgccgagtcgaggggcgctctggctcatccagatgctcggcacgcgcccgtcggcactgcgcgagcccagcagattgaatccgttcttctcaagcagccattccggatgctgcgtggcgatggcgagaccctcttcaagcgtgagcggcagacgttcgtcggattcgatgagcttgcgcgccacgtcgggctcgcggttcgtataacaggtgccggtgtgcggttcgatgaccagatagaacgggccttccggcggttcgaatccgtcggtgggcaggaagctgactatgtcgcgcggcggcatggtggtgaagccggccatgcgatctatgctggtgcgcgcgatcagcgattccggagtgacgagttcgcgtgtgggcacgagcagtatatcggcgcccagatcgctgcgctcaagtgcgcggatgagcgggcgtgccagtgcgcggaaggcgtcttcgctcatgtcggccacgtccgggtagccgagcgccacgagtcgttccagctgtttgttcgcttcgatcgatgccattgacatgcttcccagcttagccacatccatgtgcgaagcctagcccgtaagcaaaaccctagcccgtaagaacaatgacatcccgtaagaacgaacaatgacatcccgtaagggccagtccggtatgaccgaccgttacgggatgtcattgtttctcggggtgctgaaactgttacgggatgtctcagagctggtctgcgaaatgcttgcgcgcgacgatctcggcgagctcgacggcgttgagcgcggctcccttgcgcagattgtcgttggtgacgaagaacgcgaggcccttattgtcgtcgacggcctggtccacgcggatgcggccgacgaagctcggcgtcttgccggcggcgagctgcgcggtggggatgtcggtgagttccacggcgggggcgctcgcgagcacctccttggcttcctcgacgctcaccgggttttcgaactcggcgttgacgctcatgccgtgtgcggtgaacacgcccacacgcacgcaggtgcaggatgccttgagatcgggcagatgcaggatcttacggctttcgttgcgcagtttctgctcctcgtcggtctcctgggagccgtcatccacaatgtcgccgatgaacggcacctcgttgaacgcgatggtgcgcgccaccttggtgggttccgggaagtcgatggcgtcgccgccgaacacgagcttgtcggcgccctggtcaacggctgccttggcttcgttcatcagctgctccacacccgcgcggcccgcgcccgacaccgcctggtaggagctcacgatgaggcgcttcaggccgaacttgtcggcgagcggcttgagcaccggcatgatggccatggtcgtgcagttcgggttggccacaatgccggtcgggatctcgtcgagatcgtccggattcacctcagccacgaccagcggcacgtcgtcgtgcatgcgccactgcgaggagttgtcgatcacgtaggcgcccgcttcggcgaacttcggcgcccacaccttggaggtgccgccgcccgccgagaagatcgcgatgtcgatgccgctcaggtcggcggtcgcgacatcctccaccgtgatgtcgtgcccacgccagttgagcaccttgcccgcggaatgcgcggaggcgaggaatcgcaggtctttcaccgggaagtcgcgctcgtcgagcacgcggcgcatcaccatgcccacctggccggttgcgcccaatactgccacattgacgccacgatcgttgatctgtaccatttcggctccttttccggctgccgccgaataccttgttgtgagtttgcagattccgctcagcggccggtgccgccatagacaacggcctcaaccttgtcggcgtccagaccgtacgcgctatgcagggcgcgcacggcgtcgttgagctgcgagagcggcacgagggcggcgatgcggatctcggaggtggagatcatgagcacgttgatgccctcctcgctcagtgcctggaagaagcgggcagcgagaccggaatgcgttttcatgccgacgcccacgacggccaccttgcccacgttcggattgacgtcgaacgacttgtagcccaacgtgtcttgcgcggcggtgagcgccgtctccactcgggcggcgtcggagccggggatggtgaaggagatgtcggcggtgccggtggaggcgcccgcctgaacgatcatgtcgacgttcacaccgagctcggcgaggcgtgtgaacaccctaccggccatgcccggttcgtcggtcacgccgcgcacggtgacgagggattcgctgttgtcgtgcgccacgcccgaaataatcggcgtttcctgaccaaggtctgggaagaggtcacccaaagactgatcggtattgtcgctcattgtctgtctccatactccgatttttatataaaaactcgtattgtattgaataatctgcttgcagattccgtattaccgcacgttcggcaggctgttcgggtccacgccgtcgggcagcacgagcgtgcccgggcggtgcgagaacgagctgcgcacatgcaacggcatcttgaaccgctgcgcatattccacgcatcgcagtgcgagcaccttggagccgcacgacgacatttcgaggatctcgtcgtagccgattgccgggatgcggcgcgcggtgggcacgatgcgcgggtcggcagtgaacacgccatcgacgtcggtgtagatctcgcacacgtcggcgccgagcgcgacggccagggcgacggcggaggtgtcggaaccgccgcggccgagcgtggtggcgtcgccgcgttcgctttggccttggaatccggccacgatcgcgacactgcccttgttcagcgcgcgacgcacgcggtcggggttcacggcgcgaatatgggcggcgccgaactgggcgtcggtcatgaaaccggcctgcgaaccggtgaacgagtaggcgtgcgaaccggcggcgtgaatcgccatggcgagcaggctcatcgagatgcgttcgcctgcggtcatgagcatgtccatttcacgggcaggcgggttcgagtcgatgctcatggcctgatcgatcaggtcgtcggtggtgtctcccatcgccgagaccacgacggcgacgtcattgccggcgttcttcgtctcgatgatgcggcgtgccactcgtttgatcgagtcggcgtcggccaccgacgagccaccgtatttctgtacgataagagccacgatattccctctgtgagattgccgatttgttctcaagtgtacgcatgaagcacgattattgtatgaatgcacctgtaggtgtctcattctcggctcacgatgcgaaactcgcacgcccgctcacacctcacgacgcccttcgagcgcgcgagacaacgtgatttcgtcggcgtactcgaggtcgccgcccaccggcagaccgctcgccagacgcgtcaccttgatgtcgagcggcgcgagcaggcggctcaggtaggtggtggttgcctccccctcgatgttcggattgagcgccacgatgatctccttgacctcgccgtcgtggagtctgttgagcagctgcgcgatgttgaggtcgctcgggccgacgttggccatcgggttgatggcgccgcccagcacctggtagagcccgcggtattcgcgcgtgcgttcgatgctcatgacgtccttcggctcctccaccacgcagatcgtgccgtgatcacgacgcggatccgagcagattgtgcacgggctgctttcgcacacattcccgcagacttcgcagaaccgtactttctccttcacctcgttgattgcgtcgacgaggcgctgcgactccgcatccggcgcctgcagcagatagaaggcgatgcgttgcgctcctttgggccctatgcccggcagactcgcaaacgagtcgatgagccgctggatggcgccgtcgtatgccaatgccatgtaccctcctcaagcgtatgccacgcggcgtcacgagtcgccgtgttccattcgacgcggcttgacgttgagcgggttgttcgcatcgtcggccgcaaagtgctcaaccttggtcacgtcgaaaaattcctcgacggccttgaggtccatcacgtcgtgcgtctgcacatgcgcgtcgtccatcgaatacacgtcgtcatcggcatcgacctgcggtgcggacggctgggattcaccacccgccacacccgtggatcctgcatccgccgcgtgcatgccctggggtgacatgccgtaggcatcctcgacactcatggcctgaccgcccgtcacaggggacgctgtgccgaagccctgaggcccgttcggcatggcgctccatgggtcgtcgccatggacgggcgcaggtgttagcctctcgtgctgctgttcgatggactgcaccttgccgaagtcgatgtgcggatgctcgtcgaccggcatgctccacgggtctatgccatcggagacgtcgggcaccgccacatgcttgtgctggtgctccggcgctggctgctgccggttcggctcctcgtgggcctgctcctcggggtccaatgcctgagggcgcaggcccacgggcttcaccggttgggcccaggggtcatcgtccggcaacgtctgcggaccattgccattggcttgctgaaacgactcagtgggcgtcggggttgtgccggcggcttgatgcgcctccgcatcgttggaggaatccgacgtggtggcctgctgggcggaatcggatgactcgcgcgggtgtgcaacgatgccctgcaacgactgctgcagcagcttcgccttgatccgttgtgcctcctcaggcggaagcttgctcagcggaggggcggattcaccattggccatcttctcagtgggcgccaaggcgacgtcggggccgaacacgttgtgcacctgcgtgcgcactatcgagacgacgctggtggtgcccccgatcggttccttgctcaccgccagtgcgaaggcgtacttgtcgagcggggtctcgaacttgatccacaagcgttgcctgccggatttcctgtccatggcgagcatcacgcgtggcacgcgctcgcggttgatgtaggcgcgcacgtccagcggcaacgccgccacaatggcgtcccagcgctcatccacggtgccgttgcgctgaatgtcctccgggatcgaggggacgttcgaggctgcctgcggctgcgaaccggcatcatgctccgtggtggcggcctggatggcttgcggtgtggcagtgggagcggcggcctgggtgggggtgtcatgcccggactgtggtgccgtggcgccatcgttgaaaccggagggtcgttgtgcgtcgacgaacccgccgcgggcagagccctgcgtcgccgaaggggcagcagatgaaccgcgcgcgcccgcaccggcgagtgccggagcctccgcggcgaagcccgaggccctgccggccagcagcttggcggcgagcagctccagccgcatacgcggcgaggcggctccggccatgtgccccaacgtgtcgtccatgatctcggccatggcggtgagctgttgcagccccagcgcatcggcctgccggtggaggtcgctcatgtcttccgcctcggcgtcatcgctgagcacatgctcggcctcatcgccgccgagtgtgagcacgagcaggtcgcgggtgcgcacaagcaggtcctcgacgaatctgcgggcgtcgaacccggccacgatcaccttctgaatgatgccgtacagcttggcgccattctgctcgatgatcgcgtcgatcgcctcgccgagcagtgcgtccggcgtgaaaccgagcaacgccacggtggagtcgtaggtgatgtcgttgtccacacagccgcccatgagctggtcgagcaccgaaagcgtgtctcgcaccgacccgccgcccgcacgcgtgacgagcctgagcacaccgggctcggtctcgatgtgctcctgctcgcatacatgctccaaatacggggtcatgatctcgggaggcaccagacggaacgggtagtggtgagtgcgtgagcggatggtgccgatcaccttgtccggctcggtggtggcgaagatgaacatgaggtgctccggcggctcctccacgatcttgaggagcgcgttgaagccctgcggggtcaccatgtgcgcttcgtcgagaatgaagatcttgtagcggtctcgcaccggggcgaacccagccctctcccgcagttcacgggcgtcgtccacgctgttgtggctcgccgcgtcaatctccaccacgtcgatcgacccgggtccgccggtcgccagatccctgcagctgtcgcattcgccgcacgggtgcgaggtggggcccttcacacagttgatgcaccgtgccagaatgcgcgcggaactcgttttgccgcatcctcgcggcccggagaacaggtatgcgtgggtgagcttgttctcatccaaggcgtgcatgaggggcacggtaacctggtcctgcccgatcaccccttcgaaggtgtcgggcctatacctgcgatacaacgccaatgccatgtctatcccgtctgtttgcaatgcgtatgcccgagtggccggcatgcctgccggagcagtgcatggctgtctcgtgccgcataccgatgtgctatataacctagcgcgtgaggggcatcaaaatccactcggcaatgatgccccggcatcacggttgcgatgcgccgcgtgttgcgtcgacctcatcgcatcgccgtggtccggcacgcgcgcgtgcgctcacccgctccacgaacggcacgcctgttgcggtgctgacctccatggccacatccatgtcgatcacctcgcatgattccacggctcccgcattgttgcgcgccacggcagagccgatgccgcaagggtcggcggcagcctcgttccaataggcgtcggcggcggccaatgccgacatatcggctgcggtgcgcgcctgcgcccgggccatggcaatcctggccccggccgcgatggtgcacagcagcacggccaccacgagcacgatgccgaccgcactcggcgacgcattgccggcatcctgcgcccgcagaccatgcggaatgcatggcgcggatcgcgtcggcacacgcctcgccgcagcgctcatccctcgcctgggcgcactccctcgcagacccatttggccacctccttcatagcctctcctgccatatgccatgtgcacgccccgtcaccattctcggcacgatgccccaggggtcggccaccaccgcgcagtgggcgatcacctcgaacccgattccggcgggacgcacctctatgcgagcgccatcgccagcagccgcctgagccatggcctgcgagcccgaaccgctcccctgcaccatcaacgcccgcgcggcgttggccgccgcgtcctggcacccgaccgacacgacggatgcccggcccaaatagagcatcaaggccgccagcatcacgatgaccgggagcaccaccgcgaattccgcggtggccgccccctcgtcatcgcactgcaggcgacgcaacgcctgcccgaatgcatggccgcccatggcctcacacgttcaacgctttcttcacgatgttcgtgagcagcgtcttcaccgtgtcggatttcatgagcgccaccagcaccgcggcgaatccggtcgccgcaacgagcaccaccgcgtattcggcggttgccgcgccttcctccggctgggacatgagcgcccgccatctcgcctccaaaccgacctgcgcccgcagcagccggtccgaagccgcattgatgcgctcacccacgccatgcctcctgtgttcgaacaggatcacctcattgtgttccatatctctccttgcctgtttcgttggcctgtatgttgtgtttcccatctggtctcccagatgattccactatgcggccgccaatattcggtgtaaagccggacggacgcatgtggataactccaccgttatccacattgcgggtcgccggcaatgtggataacctccgcgcacccgcctcacatacgcatgaacgacatgatcgtcggcaccaccgcgatgagcaggaacgccggcagcaggcacagtcccataggcagcagcaaccgcaccgacaatcgcgacgcccgttgctcgatccgcgcgcgttcgctgccgtccatctgctcaatggccgcatgaatctgcggcagcggcgagacgccatcctcccaggcggcacgcaatgtgcggcatgccaatcccaatgccgaggaagccggggaggaaccatcatgttccaacacggcccacgcctcatcccagcacacaccgcgcagcagtgcggcggagacatgccccagcacctgcgcgcatgcgccgccgcagcatgcgccaatgcattccaatgcccggggaatcgcgacgccctgagcaatcgccgcctcaagcagttgcaacagcaacgtaggagacggctcccagcccgggcatacctcgagcaatcgccgctgcaaggcattgccgcgccccgccagcgcaatctgcgagcgcgccagtccgtcaagttcgcgcaaccgacgtgcagcaatccgctcgttcccaaccatgtgcaagtaagaggcgagcgccgcgcagatcgcggcacaccacgcccagaatccagccacaggactacccgtccgcggcaagcaggcgctgcatccacagcagtccgcccacataacaaatcgtgcccaggcacagcatggcgcgcccctgtgccgagccgaacagcatgcccaacggatccgcgccgagcagctctcccaggaacaccaccaccgccggcagcgcgagcagcatgcgcgccgtggatttgggcatcgcgaaggcattcgcgcgcaaatcgtcttgcagccgggcacgcagatagcctgcgcgcaccgcctcgaggcagcgtgcggccgggcaccccagttccaggctcaccgcgctggccacggcgaccccacaggccacctgcgcgcagtgcgaggcgcgctcatggggcagtctgcatgctgcgaacaagcgcgccatctgggtcacatccacgttgccctcgccatcgcatacggcatacacaccgacggcatgcccgtcgccggacgtagtggggtcgcgcatgtggcgcgcacgagcacctccgcaccggcgctccgggaacaccgagtcaaatgcgcgttcgagcgcgggctccagcgcggcaccggcctgcagcgatgcgatgatcgacgagagcatgacgctgatgccgcatgccggctcacacgcatggtcagccacgcccgattccaccgtctgcaggcgccatgagaccgccgcaggggcggcccatatcatcaacagcacactcagcgccgccgcgagcgcagccacgaatgccattcgtctcaccttcgttccggcacccgcttggtgccccaacgttcggcgaatggccgccatgcctcgccggcgacaggctcgccacggccatcccacgagcacaccgtgcggccgacgagcctgccctccaccatgcacagcatgccgatctgcgccaagtaccgtttgccggggcgcctttccatgtgaagcaccacgtcgaaggccccgtcggccagacccgccatggtattcggctcaacatgcgcgagcagccccagcgagatcagacgcccgggcacacggctcaccccgctggcatgcagtgtgctcatgccgccgcaatggccggagttgagcacgcgcatcaggtcgatcacctcctcgccgcggcattcgcccaccaccacgcgggtcgggtacatacgcagcgtggaacgcaccagatcgcccatcgtcacctcgccggcaccctccacgttcttggctcgcgcgcagagtgaaaccgtgttgagattgccgagcccctgcagctcgcgaacctcctcgacgagcacaatgcgttcggatgcgcggcaattgagcaacagcgccttgagcaacgtcgtcttgcccgagccggtgctgccggtgatgagaatgttggcgcgggccagcaccaggcgatccagtatcggacgccattgcgcaggccagcaaccagcctgctgcaatgcatccatggtcgcgctcatgcgggagggcagacgaatcgaaatcgacgcgccatacggcaccaccggcgcgatcaccgcatgcacgcgggtgccgtcagcaccgctcgcatcggctatagggcgggcgtcgtcgagccgctcacccaattgcgcacacagctgcacggccagacgacgcaccacggcaggcgaatccagcggaatggacgggtgctcgagctctatgccaagcccgcgctccacccacacggcaccgtcgcaggtcaccaggatgtcggtgacgcgcggatccgcagccagccgtttcagcgggccgaaattcaccgggcgagtggcatccacggccgtcacggcacgcacagcggggtgcacagtggtctgcgcagcggtctgcacagtagcgcccacaccggcatgccgaggtgccgtatccggaggcaccggcgcctcgggaagcggaaccgccacgccgccggttgtgttcgtcaccccattcggccctacaatctgccacatcatctgcctcctatgccgcacgcacgctccaccatctcggccacatcgccgagcacgcgcgcattgcgccgatgcacgcgccgaattcccaagccctccagaatgtcgccacagagtctggcatcggagcggaccgggcccatcagctcgcactccatatgctccatctgcaagtatttgcgcgcctcctccaacgacaccgccccgcggcccttcgcaaccgcaggcggctccacgcacagcacgccgatcacacgccccggcacgcccacaatcggcttccactcctcccccggccgcggcggctcctgcgcacgcgccatattgcgctcgccattgcgacgcagccattcgatatgtgccttggcacgcgccaatcccagcacggtgagctccgccaccacaatgtgcgaggcctcaaccaatgcgggcacatgctcaatctccaatccatgcccggcatcgaccaccacggcatcgctcacctgtgccagcgactgcagtgccgcctgcatctcgaaccacgccggctcctcctgcacccagcagttgtatgcgagcacgcccacgccgtcccagtgtggcaatctgcgacgcaatgcctcgccatcgagctcgccgagcggcgcatgaatgtcatgccaccgcgacccggactcatgttcaatcccgagcagcacgtccagaccgccgccgcccgcgcgcacgtcggcgtccacgattgcgcactcgttctctcgcttcgccaattcgcgggtcagcatggccgccagtgtggtcgttcctgcaccgccgctcgcgccggacagcgtgatcacgttctcgcacggcgcctgcgtcgcacacaccggcatgcgcgcgtgctgcgcccccgcatgggttcggcgcgcgggcggcgacagctgcggagagcacgcaggttccgccatcgcgtgcactggctggtatgcgggcaccctgcgtgcagactccgcctgccacggcctgcgggcgcgcgcgtcacgcatgcgcacatcacgcgcgcatgccccgttcattacctgtggccgatggaacgaccacccatggcgctcggtatgcggcgcccctacactgatctgcatagtcatagttgcattgaacgtgggttccgcaaccggttcaatctctacgaggcattgtggtcggagaacgcgttatccacatcgcgggtcgccgggcatgtggataacgcggccgccgctgagtcacatacaccgccgcagacttcttgccaagaactattccaaaacaaaggcgttttttcatgaaataaaaaagagacccacacgaggtgggtctctttcccaagtccaacgaggcagaatctctgcacaacctcatcgttgtaacggtaagtctttccattgcccgcccaacgtaataatcttgctgatcatctacttttgtgggtctgctcttcggttgtccttgtacttgcaattatgctcggaatttaggattacgcaagtcggaatcgcctaagcgtcacaatctgaccacatgtgctctttttatctttccgtgttcatttcaacaaggaacctcacagagaaaatcgcacattctgttcacttcagccgcctagatgttcaatcactcaaatacagcggcaatacttcggcgtgtcgctcactgttcgccgaaaatctcacattttcacgaacatacgaagtccgcgaatgtaccatggtgttttgttgtgcgtcgggcaatccgcatggccgcaatcatccaaaccatctcccgcgcagagctcaacgcccgccgcacggaaacggcagcgcggatcggcaccgcgaaacgggcccatccgtggacatattccgaattctttcgtgaactcagtgatttttcagcccgctcgttctaaagtagaaccatgtcacagattttcaacgcaccatcgaaggcgattttgcgcagccagattgccgaacacatcgctgaaacggacaaaagcgacaagcgggagaacatggagggcgagctcccgctgccacccgaccgcttcttcgaccgcgagctcagctggctcaaattcaacaaacgcgtgctcgaacttgcgcaggacgagacgatcccgatcatcgaacgcgcgagcttcgcggcgatcttcgccagcaatctcgacgagttcttcatggtccgcgtcgccggtctcaagcgccgcatcgacaccggcatcgccgtgacgagcgcgagcggactgagcccacgccagcagatgcgcgcgatctccgagcaggcgcaccgcttgcaggacgagcatgcgcattacgtcgtcgacacgatcctgcccgaactcgccaagcagaacatccagctgctcggctgggacaagctcacgatcgccgagcaggagcgcctctcccgctacttccgccagcaggtcttcccggtgctcacgccgctcgcggtggacccggcgcaccccttcccctatatttcgggcggttcgatcaatctggccgtgctcgtggagaacccgacctccggcaagtcccacttcgcacgagtgaagattcccgacaatctcgacagactcgtccccgtcgacgacatgaccgaagacgaggcggaggacgtccgctacggcttcatcacgatggagaacctgatcatcgcgcatttggagacgctgttcccgggcatgatcatcaaggaggcgcgttcgttccgcgtcacccgaaacgaagacatcgaggtggaggaagacgacgccgagaatctgctcaacgcgattgagaaggaactgctgcgccgccgtttcgggccgccgatccgcctggagatctccgatgagacctcgccgttcctctcccagctgctcgccgaccagatgggcgtgacgccggacgaggtgtaccgtctgccggcgccgctcgacgctaccgtgctcttcgaactcggcggcattgaccgccccgacctgaaattcccgcccttcgtgccgaccacgaaccggcagatcgccgaggtcgagtcgagccgtgcgcaagacatcttcgccgcgattcgcgagcgcgacattctgctgcaccacccgtatgactcgttctcgacgtcggtgcaggcgttcctcgcgcaggcggccgccgacccgaaggtactcgccatcaagcagacgctctaccgcacatcgagcaactcgccgatcatcgacgcgctcatcgacgccgcacaggccggcaagcaggtgctcgcgctcgtcgagctcaaggcgcgcttcgacgaggatgcaaacatcgcatgggcgcgcaagctcgaacgtgccggcgtgcacgtcgtctacggcattgtcggattgaagacgcactgcaagctctcgctcgtcgtgcgccaggaggcggacgggctcacccgctactgccatgtgggcaccggcaactacaatccgaagaccgcgcgccagtacaccgatctcggcctgctcacctgcgacccggtggtggggcaggatatgacgaagctgttcaaccagctgtccggttacgcgccgaagtcgagtttccaccgtctgctcgtcgcgccgcgcaccgtgcgctccggtctgatccagcgcattcgccgtgaggaggaggccgcgcgcgccggcaaggaagcgtggatcaagatcaaggtgaactcgatcgtggatgagaagacgatcgacgccctctaccgcgccagccaggccggtgtgaagatcgacatcgtcgaacgcggcatctgttcactcaagccaggcgtacccgggctttccgataacattcgcgtgcgctcgattctcggccgcttcctcgaacacagccgcatctacgcgttcgcgaattccgacggtccgcagattggcgagggcccggtttccggaccggaggtgtggatcggttccgccgacctcatgcaccgcaatctcgatcgtcgagtcgaggcgctcgtgcgcatcaccgcgcccgagcaggtgcaggagctcatcgactacgtggacctgcagatggccgacacgacgtccagctggcatatgcagcccgacggcacctacgtgcgccattcgaaggacgccgaaggcaagccgctgctcgattgccaggagtacctgatcaagaagcacatgcgcaagaaggccacgaactgacctgccgccaatctgtgtaaatagattcctctgcgtaacaagggacattgcgagcgcgacaatgtcccttgttacgcagaggaatcttttttcgcagcgaatggcgtagtctgaaaccatgagtgagaaacgaactgtggaggctgcgggcggcatcgtgtaccgcattgtgcgcagcatcggctcaatgatggctccgttgagcgcgaacgacgtggaggtgtgcctcgtgcaccgcccgaaatacgatgactggagctggccgaaaggcaaactggaaatcaacgaatcgcaccggcacgcggcggtgcgcgaaatcggcgaggaaaccggcttccccgtcgcgctcggcccgttcctgggcgaagtggagtacccgctctcctccgagggcaagaaaacgcgtcacacgggccgcggagacggcaaggacgcgaccaagcatgtgctgtactggatggccacgcaaatcagcgacgacgacaactggcaccgccgcgaggccttcggccccattcacgcggtcgatctgggtgaggtgagcgagattgcgtggctctcgctcgacaaggcgcgcaagaggctcacgcattccaccgaccgcgatatgctcgcgctgttcgtggaccgcatcgaggaggatgcgctcaaggcgacgccattgctgctcgtgcgccatgccaaggcggagccgcgcaaacagtgggacggcaccgagccgcaccgcccgatcaccccggagggcgccgccgccgcgtatgcgctcgaccgcgaactcgcctgctataatccggtcgagctcgccacttcgccgtggacccgctgtgaacagaccatagagatgctctcctggcaaacgaaacgcgagcgccgcgcactgccgccgctcaccgaggaggcgttcgagcgcgacccgcaggcggcctggcattgcttcgccgagcagatcaaacgcgtgctcgagaccggcaacacgatggcgatctgcatgcacaggccggtgatcggtggtatgtttgaacatctgcgcccattgtgcgcaaccaaatcgctggccaagagactcgtcgcgaaatcgccgtacatggccacggcgaacgcgttcgcgctgttcctcgtgcagaccgaagacggcccgcgcatcatcgacatacagaaagtgacgcctattgtctactaattccatgcattccggctccggctcgattatcgcgagccgctccgcattcacgcacacgggctcgccccgccccgcgcgccccggccagctcgatcaggcgattgccgagggactggccagcgacgtcgatcccgagcgcctgcgcgaagtcgcccacacgaccgcctgggccctgctgagcaaggtgcacaagaccgacgaccctgccattgtggagcgcgtgctcacgctggtggaccgcgagggggtcgacgtgatcgccgaactgtggagcaaagcggagccggactcgctgcccggcgtgctgtggcgcttgtatctgctgcggtcgtggatgcgcaagcagcgcgatacaatcgcccggctatggcgcctgggcgagccgattgccacctccgcctccgcgatcgccggcgtggactccgcccccaccgaagatgacatcgcgcgcactgcggactcgattctcaccggcgcgttccgcggggatttcgcggtcgcgttgacgcgcgcatcggtgttcgttggcatcgtcgcactcgggttgcgcgtcgaggcgcgcgagctcacgcagcaggcgaatctgaatcctgtaggttccgccgccgagcagagcaaacggtggcgcacgcaggccgcgcaactgctgcataccgcggcgaatctgaacatcacgagcaaggatttcaagcacggcgcggccctgtggcgtcaaggcaagctcgagtaaccggccggtttgcgcggcgcgcacttcccgcgtgacaaaccagtgcgaatctgcacgcattcgtcgcattggcaggcccgcaacatgacgaacatatgcgctcatgcacaggtttgtcatatctgcagattgcccgcacgacaaacccgtgcactctcgcgcatatttgccatatgagatcgcagattcatcgttcggcgcgctgcaggccgacacaccttggcggagggtgtaagcttgagtgttgcgccgggccgtacatagccccgggctccgttttttgccgctgcgagcggcctttgcgccgacaggcgcttttgcggtccggcgttttctcaacagcgtgcgcaatctgaacgcataattcggcactgaatttcgtgttttgtcacccgcgaacacaaacaaggcttactctagtaactatggaattgcatgtactcaatcacccgctcatcgagcacaagctcacggtgctccgcgacaagaacaccccctcctccacgttccgcgaactcgtctccgagctcgtctcgctggaggcctacgaagcaacccgcaatctcgaggtcgtagacaagccgatcgaaaccccggtcgcgcccatggtcggcaagcagatcgccaagccgcgcccgatcatcgtgccggtgctgcgcgccggtctgggcatgctcgacggcatgacgcgcatgatgccgagcgccgaggtcggcttcctgggaatgaagcgcgacgaggagcacccgacccagcagatcacctatgcgaaccgtctgccggacgatctctccggccgccagtgcttcctcatcgacccgatgctcgcgaccggcggcacgctcgtcaccgcgacgcactacctgatggacaaaggtgccaaggatgtcacggcgatctgcatcatcgccgctccggagggcatcaagttcgtcgaagagaacattcgcgaagacatcaacttccgcgtggtcgtgtgcggcgtcgacgaaggcctcaatggcaagagctacatcgtccccggcctgggcgacgccggcgaccgcctctacggcgtcatcgactgaactagcatatcgacaaactgtacccccgaacagatctactcatgttcgagggtacggttttttgttgaggagtacaggtcagaaaacgctcagactcactgcttcggcacgaacgcctcgaaaatgaagcggtcgaagtacggctgcgcgcccgcgagctcgtcggaggtgcgcacggtccacgccacggccatcgcgcccattctgcgcacgaagcgcaacatggcgccgttgccgttccggaaatcgtaggccacaaaatccgggcgggagatctcgttgaacatgagcttgccggccatccacagcaccgggttcttcgtgaactccgtgtcttcggcgagctggccgcggcatacatcggggtgctcgcgcttgtaccagttcatggcggccgggttgaacgactccaccacatacagtccctgataggcgtcgagcagggcggccgcggtctgcatgagctcctcgtcgcggtcgtcccacgtacggtagttctcgaatttgaattcgacgatgatcggcacgcggccgtccaccacgcgcagcacatcctcgagcagcggcacatgctggtaatacccggccggcgcctgcgacggcgtggtcacaagcggcggattctcggtggcgccgggcagcagcggggagacctcggcaccgggagccgccgtggggaacagcgggatgcgcacaagctcgtcgtaggtgaggtcgcgaatatttcgcggatctcccgccacacgcagcagatcggggtcatggcatacgaccgctttgttgtcgagcgtcagctgcacgtcgagttcgatgccataccccgcctcggccgccgctgcaaacgcggccagtgagttctcaggtgccagcgggccgggctcgtcgatggagccgtacccggcgcgcaatgccatgcgacgcgcgagcgcgatgtactcgccgctttcgccggcatgctgttgcgagagaccggatccggcgtcgtgcagaccgcggtgcgcatacagcacatccggcagcgtgggcacgaagttcttccgtttgttgttgaaagtgcgcggggccaccgcccacacgcccaatcccgcggccactgcgccgccaatcagcgctttcttcaatgcattggccatattgccctccctaaactcgaaagcacgtcactatgcacgagattacccgaatccgcgcacgcgcgcagcctacgcgctcagctatgcagcgcgcgccaccctctgtgctgctacttgcgcgccttgtgtttcgccgcgtgccgtttgattagaatgtcgatcacgatccagaccgacagcacgaacgccgccacgtacccgaggaacccgaccaccggtatgccgaagatgatcggcttcatgccggcgaaatacacgatcgaggagccaatgaacaggccgaccacaatgagcgccatcgtgagacggttcaccatgtcgctcatctggctgagcggctcctcggagcccacgagctcgagattcatcttgagttcgccgcgcgtgagcatgtgcagggcggtctgcgcgtccacgatgcccttaagcccgctgtgcagcgcctgctcgctctctatgccgagtctcttcacctcggatttcaccatctccaccggcgttttcgacgattcgatgtgctgggagatgatctcgatcatgttgacgttcggaatgaactcgtcgagcagaccctccaacgtcacgagcgcgcgccccaccgtggtcaccgagctggggatctctatgccgtgccggcgcgccatctgcgtgagcgaggtgatgaacgccgccagatcgaggtcggcgaggtccacggtgccgaactcctccacaatgccgtcgagatcgccgagcagcgacgggtagtccgcccgctccacatcggtgccggcgaagcggagcagcgcgtcggcgagatccgctgagttctgcttggccacggcgaacagcatctgtttgagcgccacgcgggtgcgcgcgtcgagtctgccggtcatgccgaggtcgagcagaataatcttgccgccgcgaatctcgatgttgccggggtgggggtcggcgtggaagaagccggcgtcgagaatctgcgcggcgtagttgtcgacgagcttggtgccgatctcgttgagcgagtagccgtcgtcgatcagctcgcgcgtatgcgagatcggtatgccgtcgatgtattgcatgacgagcacgtgctcggtgcacaggtcagtgaacggcgtcgggcagtccatgtacgcatagtgcgagcagaaccgtttgaattcggccagattacgcgcctcgttgaggaagttcgtctcctcgtcgaaggtctcccacagctcctccaccacgccgcggaagtcgaccacctgcgagctgtgcatgattttcgtggcgcccttggcgagcgagcgcatgatcgagacgtcctgcgccattgtttcgcgcacgcccggccgctgcaccttcacggccacgtcctcgccggttttcagtgtcgcacggtgcacctgcgcgagcgatgcggaaccgagcggcgtagtgtcgatgtgctcgaagatctcgtcgatgggccgctggtattcgttctccagtgttccgagcacaatcgcgtacggcatcgggtcggcgtccgcgcgcagtttggaaagctcggcgcagaacgactcgggcagaatctccgaccgcatcgacagaatctgaccgaccttcacgaaggtgggcccgagcgcttcgaacatgaggcgcatcttgaccggcgtgaggccgtgcagcgcgtcgtattcgagcgcgatcttgccgatctgcttgaggcgtttcgccttgctcatgcgcgtcaggtggtattcgctcgagaaattgcgcttatgcatgccgaacagaccgatcgtctcctcgacctgcggctgctgcctgcgcgcgatgctcgccgggatgtcgtgggtgtgcgcgtccgccgggcgttcggactgcgcagattgcggcgctggcgtttccggctgtgccgcggtttcgctcgcctcaccgccggactgctcggcttcctcgcgctgcagattgtgttcgatggtggcgccttgctcgtccacttcatcgccaagatgcaggatcttctcggattcggcggtctccaccgtcgcccgcaatgcgtcgtcggtcggattgtcgaaagccgggccgtcgctgtgtgcctcctggttctccaaacggttgctcaggtcaatgagctcggaggtctcgcgcttctcctcgtgttcgagatggcgtgcctcgcaggcgtccttgcgctgctgcctgcgctgcccggcctcctcgcgtcgcacgtcacgcctgagctcatgcgcctcggtttctcgcttggacttgtcgctgttcttgtcgctcatataagaatcctacccagtcgggaggccggcgtcgccggcgcatacgggtgaacatacacgcgtgcgccgcctgaatccagacggcgcacgcgtaggggaatcacagaatcactgctcgtcggacttcttctcggtggccttcttaatcgtctgctcggcctggtcgctcagacctgcggccgcattgcgaacggtgttggaggcgtctgcgagcttctctttgagcgagtcggacttctcgccggccttgtgggcgagttcggagttgagcttcttgccctgctccacggtgagctcaccgcgcttgacgaggtcgttcacgagctcctgacccttctcggcagtagctgcaatggcgcccacgcccgcaaggaacaccttgcgcaggccttcgccgaagtccggcatggcggagttggtcttgttctcggtttcgttcttggtttcgtcagtcatagtgccctcctgggtgtgtgttgaagctggtacgctcaactctacacgcccgcaaacgcagacggtcacgccgtgggttttttacccgagagcacagattctcacactcaccggggccgtgtagccgccgcctcgcgcgcgtgcgccgcgtattcgtcgatccgcgcgagctcggcacgctgggcgtcggtctgctcggggtcgaatgcgccgtagcggcgttcgaccgccgtgcggatcatgaaatcagtgattttcgggttcttcggcagcagcgagccgtgcatgtaggtgccgattacattgtgcacgcgcgcgccttcggtgtggtcctcgccgttgttgcccgtgccgtcgccgtccaccgtgccgagcggctgcacgccctcgcgcaggaaggtctgcccggagtggttctcatagccaagcacatcgccgaactgtgcgctgtgctcgacgagattgcctatcatgcgcacgtcacgacccaccgtgtaggcgcgaatgatcgagatgccctcaagtttcgtgccgtcgatcgtttcgaaatactcgccgaacagctggtagagcccgcagatcatgagcatcggcacgccgtgctccgcgaggtcgcgcaatctgtcggcacggcggaagaggtcttcgatgatcttcttctgaccggtgtcctggccgccgccacccagaatgatgtcggcatgctcaggccacgggtcgttctggttcacggcatgcacatgcggctcgtacccgtacagtgcgagcctgcgctccacggcgagcacattgccgctgtcgccgtatatattcatgtctttcgggtagagcgacaccacgtcgattgctttgctcattccggctcctcccctactcctgtcttgtatttgcccaatcggaaaatctgctgtgctgaatccgctacctacttgcccacgccggcgtccgccacgtcggccacggtggcgagctcggcacgaatggcgagcatggccgtgtacgtgcagtagatgtgttttggcgtgcccggattcgcgttgacgaactcgcgcacggcagcgttgaggtcgggttcgaccctcgccaccggcacctggtcgtattccaaacgcaatgccatgtcccacgcgcgcacgccggacaccatcgcgacgccggtgggccgcagactcgtgaaatcgacgtcccacagccagctcatgtcacggccgtcggcgtactggtcgttgatcgcaatcatcgtgtcggcgctttcaggcgggaacgaggcgagcgccaggcggaagcccatcgggttcttgacgagcagcagctccactggggaaccgttcacgtcgatcacctcgccgcggccgaatgccggcgtcacgtcggcgagcgcggcgaacagcgcgtcggtgtcggcgtcggcgaatgtgtgagcgcgcgcggtgaatgcgcgggcgcgggcagaatctgcacgccccaattgggcggccgcgtaccccaccgcgttcggcttgcgcaggtcagcctgcacggcgcgcaccacggcgagcgcagcggccgcattgaacagattgtagacgccttccagcttgacgtcggactcgtattcacgcccgtcgatcaccatctgcgcatggtggtcgcccaccttggtgagcatgacgtcggcgtgcagctcgtgcgcggtgccgacatcgtgcgcgacgtcgacgatctgcgcatccgcagcttcgggagcctgcgccgagtctgcggactgcacctggaacgtggtggtcatatcgtcgtcggcggggaaataatggcgcaggccttcggccaagccgaagtagcgggtgcgcacgccgtccttcaccacgtcgcgcaggcgtgcgatgcgcgggtcctctcggttgagcaccacggtaccgcgcgtcgccgcggcaacatggccaagaagccgagcggtgttgtcgatctcgccgaaacggtcgagctggtcgcgcatcacattgagcagcagcgcatagcgtggctgcacctgctccacgaagtgcacggcgtaggcctcgtcgagttcgagcacggcgatgtcggcgtccaagcggccgttcagcggcacttcggtgaggatcgacgagacgacgccacgcgtgaagttggagccggtcgggttcgtgaacaccttgagacccagcgattcaagcatcgtggcgaccatgcgggtggtggtggtcttgccgttcgtaccggagacgagcaccacgccgagcggcaatgtgctcagcgtgcggctcaggaacgtggggtcgaaccgttccaccaccttgccggggaacgcgctgccgccgtgatggagcaggcgcgaggcccagcgcacggatttgcccacgaacggggtcgcaaagccataccagggtgcgtgcgtgcgcaccgggttcgcattggaggtgccggaatctgccatatgcctgcctcttgtcaatcgtgtcgtcaatcgtgttcgctgttgttatgccaattcatactcgcatgccgcgcccacccgtgagatgcctccgcgtcacacctcgcggttcatgtcgctgaagcgtgagtactggccttggaacaccaggccgaaggtgcgcgtcgggccgttgcggtgcttggccatgatgatgtcagcctcgcccgggcggtcctcttcgtcgtagaagtccgggcggtgcacgaggaacaccacgtcggcgtcctgctcgatggagccggattcgcgcaggtcggaaagctgcggtttcttgtcgttgcgcatttccgggccacggttgagctggctcaacgccaccaccggcacctcgagctccttggcaagcagcttgagtgctcgcgagaactcggagacctcctgctggcggctttccacggccttgcccgaggtcatgagctgcaggtagtcgatcacgacgagcttgaggtcgttcgtctgcttgagccggcggcatttcgcgcggatctccatgaggctcatgttcggcgaatcgtctatgaacagcggggcgtcctgaagcctcgcatagaagttgttgagcgtgttccagcggttcgggtcaatgtcgtcggcattgcgcaaggcggccagcggcacgcccgtctccgccgagatgatgcgctgcgcaagttcgaccttgctcatttccaagctgaacagaatggtcgtgtcgtggtggtgaatggcggcggagcgcgcgaaatccacaccgagcgtggacttgcccatggccgggcggccggcgaccaccaccatctggcccggctgcaggcccttggtcacctcgtcgatctcctggaagccggtgggcacgcccgcctggagctcacctttctgaatgctgtcgatctggtcgagcgcatcgtgcacggcggcctgcacgggggcgtagtcctggcgcacgcggccggtgctcatctcgtacacctcggcctgcgccatgttgatcacatcctgcgcctgcgagccttcggcgtcatagccgagctgcgcgatctttgtacccgaggcgatcacgcggcgcaacagcgcgcgctggtgcacaatctccgcataatacgaggcgttcgcagccgtgggcacggaggcgatgagcgaatgcaggtagtcgatgccaccgaccttgtcgaggtctccggagtcgctcagcctgttggccacggtgacggcgtccgcgggctcggatgcggagaacttgccaatgatcgcctcgtagatcgtctggtgcttcggctcatagaagtcatccaccgaaacgatctgcgaaacctcgccaatggcgtccttgctcatgagcataccgccaagcgtcgccatctcggcgttgtcgtcgtgcggggggacgcggtcgaagagaccagcggcattggcgctggtgtcggtgcgagtgttgttgtggaatccgtcagccatagctctcgattataagggggcatgcaatgtactgagtacgcgcggtgtcgcatgccattcagctgatggacacccgcacctgcttgcccatggctcgggccaagcgcgacagtgtcttcatggagggattgagtttaccccgctctatcctgttgatggtcactctgctcacgccgctgcgctcggccagttgctcctgggtgagcctcgcctcctcccgggcccgcgatacggcgaccgccgcattcaaacgctctatttcggcctcgaacaccgtcgcgaattcgggatcgtccatctgttcatcaagcatgctgttgaagctgcgcataaactcctcactctcctttctgtgcgagtaatctgtagattctcatggcacgatctatctcgccatgaggcgtcctcatatacttcgaacactatcctttccatcaatagaatgtagcatatatgctacattcatgcaatccgggtccttactaccaatgattgcagatgcaggcgcatgcgcagaaatcgatgaatgacaaggtgaagagtgggcgcgggcgccatagataaaatcacctgtggataactgtgggagaatcctcgagttatccacatgatggggataaccctgtggataacctgtgcagttatccacacgaccatgttcccgttgtggataatcacagtggcgaaacgctcacatggaggcacgcgccagcgcggccatctgcgtcaccagacgcgcgcgccatttgctccaccccaccgtgttcgagatcgtctcgccggcggtggcgcccagcgacgacatgtcagccttcgtcagcgcgaacagcatgtcgagcagctgggggtcgccgtccaccagcgacgccagttcggcgcccacctccgggtcgttcgggttgcgcgagctggcgaaatccgagagtgtcaggtgttcgcgcacgagcaggcgcacccaatccaccatctgatcgtcgaatcccatgcgccgcacaatcaccgcagcgtggcgcgcgccctccgccgcatgatcggctacgcccggccgcttgcctatgtcgtgcagaatccccgcgagcagcaacgccgtgtagtggacgtcatcgaaggcgccgccgttgactggccgctcacgccccagttgcgcggtcactgcgagcatatgccggtcgatcgtgtagcgatgcgccgcggagacgctcggccggttgcgaatcgcgtcccattcgggcatcagtctgcccggaatgcccacgaaatcgagctcctcccacacctgcggcaaccgctcgccactcgccagcaattccacgaacagccggcgcatctcgtcactccacgccttgtcgtgaatcggcgcacgtttgagattcaccaacgtggacgtattgatcggcagaccctcacgcccggcggccgcggccacgcgcagcggcagcgcggggtcggcgagcgggtccgcctgtggggcgagcacgatctcctgctcgtgtttggcaacgcccggcgcgagcatctcgaatttcggcgcctcgcgcttgccgccggcgcgcggtgagagaatctggaagaacgagaaccgcggcttgtcgtgcacgagcgtgcgttgcgcgcgtgaggcggtcgaatcgagcgcgaacgcgattgtgcggctcagactcgcgagcagcgtctgcaggtcgtcaatcgacttcgcctcacgctccccctccggcagcgtgggatcggtgagaccgagcatcgcggcgacctcggcctggtattgcgtgagcaatctgtccgcgtctttgcgcgtgatcaaatggattgcatcgcgcacgtcgagcagacgttccaccgcgtcgtcatagcggccgtgcgggcggtcggcgagccaggaggcggcgagcgcggagaggagcaccgtgtcgcgcagaccgccgcgcgactccttgatgtcgggctggttcacatacgacattctgtcgaagcgctcgttgcgcacgtttgcagattccagcagttcgggcagccgtttgcgcgccgccttgcgccaccgttcgaggatcgccgtggccgtggtctcgatcaggtgccggtcgccggcgatcgggttcacgttgagccagcccatcgcagcgggcagatcgtggtcggtcaccgattcgcatcggctcaccgtgcgcaccgaatggtcgaggtcgagcccgctgtcccagatcggataccacagcttgtttgcgaattcgttgagctgcgtggtggagagcgccacatggtcggcggtgatcagtacgaggtcgaggtcggaggcggggccgatctgcccgcgtgcgagcgagcccaccgcggccaggccgatgccggagtcgggaatctggaacggcacggagtgcacggcctcgttccacaatgcctcaagctcgcgcatcgccagattcgtgcgggccatgcgcttggcgctgccattgcggtagacgccgtcggcatccggctcgctcagctcgaggaactgctgtttcaatgtgctcatcgccatgttctcatctcttctcatttcgttgcgcttgttgtgccctttgcatgcacaccctttttgcgtaaaaagtaaagataccttgcgtaaaaagagacagatagcgccaaaaatgtcccaaattacgcaaagtaatgacttgcgtaaaagggacagactgcagtctgaaactgtccccaattacgcaggggaggaggggatggcgcataacttacgcagggaggccacgcgcgaatatgacaatccccgccgtacacgggccgtgcgtggcggggatgtcacttagggttatctggagaaatccgtaaaggcgtcagatcgcggcggaaccggtctcgccggtgcgcacgcgcaccaccatgtcgagcggggcgacccagaccttgccgtcgccgatcgtgccggagccggcggacttgacgatcacatcgaccaacgtctcggcatcggcatcatcggagagcacttccacgcgcaccttcggaatgaggtccacggtgtactcggcgccgcggtagatctcggtgtgaccacgctggcggccgtagccgttcgcctcggagacggtgagaccgtgcacgccggcggaggcgagcgcctccttcacatcgtcgagcttatgtggctgaatgattgcggtaatgagcttcatctcacttcatctccctaataacagagctggcggtaccagcgaaatcgtaggcacgttcgccctgatcggccaagtcgatgccggccacttcctgggcctgcgtgacgcgccagccaatggtcttctcaagtgcgaaggcgatgatcgtggtgatcaccgcggagaacgcgatggcgatgatggcgatgatcagctgcacaccgagctggttccacttgccgctgtagaagaggccagtgccttccatgaagaagccgaggagcacggtgccgacgagaccgccgacgccatggacgccaaccacgtcgagcgaatcgtcgtagccaagcttgaacttgagcgagcaggccaggcaggtgaccacaccggcgatggcgccgagcacgatggcccagatcggcgagaccacgtcagcggccggcgtgatggcgacgagaccggcgacgatgcccgaagcggcacccattgcggtgtagtggccggtgcgaatcttctcggtgaagccccaggtgagcattgcagcggcagcggcgagcgaggtggagacccaggcatagccggcgacaccgttggcggcgaatgcggagccggcgttgaagccgaaccagccgaaccacagcaggaaggcgccgagcatgacgaacggcacgttgtgcgggcgcatcggttcgacaccgaagcccttgcgcttgccaatgatgagcacgatgatgagggctgcgactgcggcgttgatatgaacaacggtaccgcctgcaaaatcgtgggcggctgcgccaagagcctgggagatcgcgccatccgccgaaagcagaccgccgttccacaccatgtgggccattggggcgtagtcgaaggtgatccacagcgcgacgaagatcatccacgtgctgtacttgacgcgttcggcgatggcaccgcagatgagcgcgacggtgatcatggcgaatgcggcctggaatgcgacgtcgacgctggccgggtagttgttgctgttgaggctggcggaggtgaacacgccatcctgtgcaaccatggtgtcacgaagcaggaagccggtggccgggtcgccgaacacaccgccgatcgaattgccggcgtaggcgatggaccagccccacaggccccagatgatcatcgtgacggaaagcgctgcggcctccatgatgagcatgttgagcacggccttggcacggaccatgccaccatagaacagcgccacgccaggcgtcataagaaacaccaggcaggcgctcgtcaatatccacgcggcgttgccggaatcaagctgactcatgcgaacacccctctcttttctatactttccatccgcctctacaacggataactctctttcgcggctccgctcggcgaggggcctacggaacccacatgtgctatggaacccccgccgagttttgagaacgttacgacgcgttacgagagtgtaaccatatgagcccattccgcatttgtggttgcattgcataacggaaaccgccgccggcattgccagaatgccagcggcggttgagcgaaaggcgcgcgaactcagatcactcgcccagaatgccgtccacgaacgactccgggtcgaagggcgccagatcgtcgggcccctcgcccacgccgacgagcttgaccggcacgccgagctccttctgcaccgagatgacaatgccgcccttcgccgaaccgtcgagcttcgtgagtacgacgccagtgatgccgatcgcctcggcgaacaccttcgcctgcgccatgccgttctgcccggtggtcgcgtcgagcacgagcagcacctcgtccaccggcaggttcttctcggccacgcggcggatcttgcccagctcgtccatcagattggccttgttctgcaggcgtcccgcggtgtcgatgatgagcacgtcggtgccgagttccttcgccttcgcactcgcttcgaacgccaccgacgccgggtccgcgccctcgcggtcggagcgcacgaccggcacgtccaccttcgcgccccacgtctcgagctgatcggcggcggcggcgcggaacgtgtcggcagcaccgagcagcacggtcttgtcttcggagacgaacagacgcgcgagcttgcccgccgtggtcgtcttgccggtgccgttgacgcccaccatgatgatgacgctcggcttcttcgcatccggcttctcggcctccagcgtgcgatccatgtctggccccaccagcgcgagcagctcggagcgcagcgcgtcgcgcagctgtcgcggatcactctcaccggtcacgcgcgcgtcggtgcgtagcttgtccacgagctcctcgctcgcctcggcgcccacgtcggcaagcagcaacgtgtcttcgacgtcctcccagtccgcctccgacagctggtctttcgcgagaatgttgaacagggccttgccgaacgggttgctcgacttgctcagccgttcgcgcagccgctgcagtcggctcttcttgccggccggcttctcgatctgctcggccggcggcgtcggcacctcgtcgaccacggcgaggtcttcgaccacagattccgcctgtgcagactcctcgcccggcacctcctccgccgcggcgagcttcggcggtgtctgggacagccgctcacgctcctgcgcctcgagttcggcgcgtgaaatcgccggctcctcggcctcgatcttctcctcgttggtcggctccgctggtttgccgccggaagattgccgcgccccgctttccgcgggctccttcgcctgttcgtgtgcctcgcgctcctcctgctcggcctgcgcgcgttctgcggccaggcgcgcgtcggcggccgccttcgcgtgctcggtcgacttgttgatcgcgttgcggcgcgagcggccgatgagccagctgccgataatcagcgcgacggcgatgaccgcgatgatcacaatggcgtaaatcgtgtttgtatccataaccccagcgtaaaaagcgcaacggacagtgccgcgaatccgcgcgaatctgaaatctgttggaaaaccaagcgtgtcgcagtatatatatatgcagatttccagcgcgcgtgaaaagatgggcacatggccaatgcttcgagaatgtcttcataccaacgtcgtgaacagctactgcgcatagggcgttcgctgttcgccgccaaggggttcgaagcggtgagcgtggaggagatcgcggcaaccgcaaaagtgagcaagccaatcgtctacgagcatttcggcggcaaggagggcctgtacgcggtggtggtcgaccgcgagatgcgcgcactcaacgacacattggtggccgcgctatcggcacaggacgtgcatccgcggcagatcgtggagcgcacggcgctcgcattgctcacctatatagaggagaacgccgagggattccaggtgcttgtgcgcgattcgccaagcaccgacccatcgagctcgttctcgtcgctgctgggcgatgtgtcgatgcgcgtcggcgagatcttgagcgaatggttcaagaagcagaagctccccacgaaaggcgtgccgtattacgcacagatgctcgtgggcatgacggtgttcaccgggcagtattgggccgaccagcgcaaagtgagcaaggagcagctcgccgcgctcattgtgaacctcgcatggaacggcctgtcacgcatgaaggcgaagccggaactgcgcttcgagggcgagaaggcgaagaaggcggcgcagcgagccgcggagaatgacggtacggaggaaacgcgcaccgaatccccctctgcgccagccccttctgcgtaaaaagagacagaaagcagcccagcgatgtccccaattacgcaaaccggccctttctgcgtaaaaagagacggaaaataccgtgcaaatgtcccaaattacgcagagggctgcactaagagaactgcactcatgcagaggaattgcgtagcggccgcgcctattacgcaacggcctgcggcctgcactcagctcatccagtggtcactcatcttgaacgcgttgtgcatgagattgctcgtcgtgtagagcacctgattgagcaacgtctgcgtgcgcatctgcaaccaatctgccatcgccttgttcgccgtctcaagctccagacgcaccgccttgagcccctcgtgcgcggagtcgctcgccagcgcgtcggcatcggcgcgaatcgaggcgtcggtgtccgcgacaagccggtggccatgcgcctgcacatcttcgatgtactgttcgatctcgccgtccgtgtcatagtaatgcgcgtcggccatcaccgcgagtatgcggttcgtccagtacagcgagttcgttgacgcattctcgccgtcggtgtcgcgcaggtaggccggcgtatcggtcacattcgcgtagaagggcgcgggcgtggtgaacgcgccggaaccgtatgagacccacatgatcgaacgataggcggcgggcgcgtacgggcgaatctgcatgcagaccatctgcccggtgcggttcacgccaatcggacggtagcggtgccgggattccgccgtgccggtcgtgccgtacgggtcgaacggcgtgccctggaaatgcgagcccatcaggaacgcgacgtcctctatggtcactttgctctccggttcgcgcgcccacggcatgtcctgcgaatccgggcggtattgcgcggccggcgaatcccagtcgtcgctcgggttgagatgccgctgcatgtaccaggcacgcggggtgttgtagatcgcgtccttcggcgtcgccgtgccgaacaccgtgcgcggattgatatgctgcgcggtgtggtttgcgaactcggggtcgggcatggcgcggtcgagatggttcgcctcgatgaaatcggccagatcggcgctgcacatattgttgcggcattcgctcatcgcgtcgtcgatgtcgagcaaatctatgccgagctggttcggaatggcggcgtagcagtcgtccggcacgcggcgcgcaatccagtgatggccgccgatcgtctccacataccagatctcatccacatcgctggcgatgatcccgttcgactcataggtgccgtaggtcgcgagcagctcgccgatgcgcgcgaccgcctcacgcgccgtcctcacatacggcagcacgagcgtgatgatgtcctcctcgccgaaaccgccgggcacctcttcgcgatagtccgcgtcaccgggttcgccatgcgccggcacgagcttgacgagcggatcggcggcgagcacgcgcgaattcacggcgatcgtctcggttgcgctcatcgccacattgtgttcgttgacgcccgcttcggcgagcacgccgcgatttgggcgcacgttcggcacaatgctgtacaggcacgggtcgccgggcagatcgatctccatgtggctgatcacactgcggtagtgccgcggctggtcttcgggccgcaccgccacgaatttcttcggatcataggtgccgctgcccgagtcatcgttgcgtgcgatgatcgtggagccgtcgtaactcgctgattttcccaccaatagcgttgtgcaagacataattacagactactcagcgcgccacccgctcgccacgccgaccgcgcacacccgcattttgcgttttcccgcacccgttgtaatatgtgcggtgttgcccctctagctcaacggttagagcagcgtccttttaagtcgtgggttcagggttcgaatccctgggggggcactttcaatttcttcacacggtttccagtgatccccaagtaattcggcagtctgtgccaatctgttccagagttcgtctcaaacttcggctgctgtactgattccatacgcaattcggtttgcgaattttctacagatatcgacacagattggggaatgaatatggcacagcacgacaacacgaacaccgagatcatccggccgcagggcggttcgcaaacccaagcggcggccgacactgcgcagatcgcgcatacccaagcggatgcgccgacccaaccacagggctacgccttcgacttcgcgcagcagcagggcgagcagattccgccaagccagggctatgcgccgcagaacggcgagcagcccttcaccacggcggccaacaccgcgcagccgaacatgggcggcaacggcgtcccgaacaatccgcagggcggtcagatgcccatgaatggcggcgcaccgggcaaccgcggcacggcgacgttgcgcggcaaaccgggcggcaagaccatcggcatcatcgcggcgatcagcctcgggtgcggcctcgtcgccggcattgcgggcacggcggtcacgaacgcgatctaccggtcgaacgaaccgtcgcattcgaacatgatgatgcgcggcataggcgaccgcggcttcggtgaaggcgacggggacggcgagtctatgccggacttcggctcgggcaacggctcgcggaaccgccgttcctaccgtgcggacggccagatgccgggcatgcaggattcagacggcgccaacggcgagtcgaacggcgatgcgcgcaaccgcagccagtccaacgattccgactcgaacgccgactccggcagctcggattccagcaagaactgagtcggaggcgccatctgcgtgccgccatctcagcctcaccctctcacctcaccctctgcgtaaggagggacagaaaacacagtgcaaatgtcccaaattacgcagaggcgaatcgcagggggcagatgcagaggagaatcgcagaggggcagattaggcaagagaacgatagagaacaatcaccagatctcgtcgatgttgttcacgagtttcaccaccgaggcgcgaatctcgggcaacgagaccgcctgcggcgtgcgcagccagaacgtgacgcccgcgatgaacgccgtcgcggccatgtcgaacacgagcgcccggttcaccgtcgcaggcccctgccgcaccggcaattcgttccggtttgtcgcatcggcatccgttccagccggcaatccctcctgagatgttgccgaaccgccattcgacgtacctggcgcggcaccgtcaccccattccgcaaccgcatcaactgccgcggcaccgccgcgctcggtttcgaacagccggtgccacacatggtattcgagcgattgcttccacaacgccacgaaccgcgaactcggctggcgcaccaacaccaaccggaactcgttctcatgcgcgtgcagcaccttcacgaacgcgttgaacgaacgcatcgtctcatcggtgccgtctgcacgcacgcgcatcggcactgcgcactcgaagagctggcgcagcagccggttctccaccgattcatacacctgccccatatgccggtagttcgcgtagaacgtgctgcgcgccacgaacgccttcttgcacagcgcagaaacgctcagatcactggccgggcggccggtctgcgtcatccattccaccagcgcgcgttctatcgactggcgcgtcggcgtgagcggcagcacctcgatgtgcgccgcagccgcatacggattcacgtcgttcataggcaccagcatagggaatctcccatggggactcacgaaaaaagcagacatttctcgcgaatttgtagcgcgccctccgccatcgcacctcattcatcgatttcaatggatacagatcaatgcatacgatcgagcgcaatcgaggtgatggcggtgcagcagaccacgcagccgacacgacccacacgccgcgagaaggtgggcgtcatcgacgtgggcggcggcctgcgcagcgcctacagcaccggcgtgctcgactactgcctcgacaacggcatccatttcgactacggcctgggcgtctccgccggcgccgcgaacatcacctcgtacctcgcgggccagcgcggccgcccgctgcggttctacaccaagtactgcccacgccccgagtacatgagtctgggcaatttcctgcgcgacgggtcgtatttgggtcttgattacatttacggcacattgatgaacgaagacggcgaggacccgctcgactacgatgcgctcgtggccggcggcgtgccgtaccgcatcaccgtcaccgatgcgctcagcggcatgccgaagtacctcggccccgagtccatgagccgcaatcactacgacgcgctcaaggccaccgcctgcctgccggtgctcgacaaaccctacccactggatgggcgcccgtatttcgacggcacgatcagcgacccgattccgttccgccaggcgtttgccgatggctgcacgaaactcgtcgtcattctgacgcggccgcgcgatttctaccgcaatcccgacaaagacatcgccagctcgatgatgctcgccgtccgctaccccgaggcggcacgcgcactggcgaaccgcgcgcatacttacaatgtcgagctcaatatgtgcaagagactcgaggcgcagggcaaggtgcgcatcatcgcgccgaagagcatcgacggcgtgagcacgctcaccaaggatcccgacaagattcagaacctctacaaccgcgcctataacgacgcgaccgcgctgcgaaacttcctgtaatcccgcgcacatcgcatctgcggcgcgcactccgcttgccatgccgtatgggtgattcccaccatctgctgtctcatatttgtgtccactatgcagattcgattattgagaatcgttctcatttgctacgctcgttattgagaacgattcccaatagatggcatagaagacaatggagagggaacagagacgagcatgacagaacaatctacaaaccaacgctccgcaacgcatgacgaaccacgacgccggccgatcacccgtaccgcgatcgcattcctcgccggccttgcggtgtgcggactcgccgccagcactctgtcgggttgcggaaacaacgccggagaaaacaggacctcggccgcagccgcacggcagaccaccgacagctgcgacaccacgatcaacgtcgtggcgtcggtgaaccagtggggttcgctcgcccagcagctcggcggctcctgcgtcaacgtgacctcgatcatcaattccacggccgcagacccccatgaccacgaagcgacaccggcggatctcacgaagctcgcacgcgccgacgtcgtggtgctcaacggcgccggctacgacggatgggcccagaaggcgcagctcgacgaaggtcgccagcgcatcgtgaaggcatcgtcgctcatgggcatcgccgacagtcaggatgaccacgaccacgaagagggcgaggggcaccatcaccatcacggcacggtgaacccgcatctgtggttcagcccggcggccgtgctcaagatgtcggaggcgatcacctccgcctacgtcacgaagtccggtgaagcgagcgagacggccgccaccgcgcgacgccactcgaatacctggaacgccgaatacgccgaatacacggcgctcgtcaaccgcgcacgggcaaagaacctgcagcgccgctatgtggccaccgaatcgatcatcggccacctgctcgactacatcggcgccaccgacaaaaccccggactcctacacgaacgcgatgaacaacgacgccgagccctcggcctccgacctcaagaacgcgcttgacacggtggggagttcgaatgtggacatgctcatcgtcaatccgcaggaaatgggtggattcgccaagaagctcgacgcggccgcacgcgaaagcggcaagacgatcatcagcgtcaccgagcagctgcccgagaaccacaagacgctgctgggctggctcacgacgatcaccaaccaagcgctggccgacgatccccagcacggctggttcctcacacagcaggtgaaggaccgcaccatagccgactacgccggccaatggcgttccgtctacccgctgctcaagaacggcaagctgcgtggcgtgatggagcacaaggcagccaccggcgacaagaccgcagacgaatacaccgcctattacgacgccggttacaaaaccgacaccgagaccatcaccatagagggcgaccgcatggcattcacgaccaacgggcgcaaggtgacggccacctaccgctacgacggccatcgcatcctcgactatgcgaagggcaaccgcggtgtgcgctacctgttcaccgccaccggtgacgtgccgcagggcgcgccgaaggccgtgcagttctccgaccacggcatcgcacctggcaaggccgcgcacttccacatcttcaccggcgactcccacgacgaggtgatcaagcagatggagcactggcccacctactacccggcgtcgatgagcgacgacgagatcgtcaaggagatgctcgcccactgacgttcctgcggggccccgaccgcattcgcccggggccccgcatgtgcattcagaaccgcacgatgcggtcgcacacctcggcggccagctcgtcgtcgtgcgtcacgacgagcacgcacacgccacggtcagccaggtcgcgcatgagcgccccgacctgcagcatatggtggcggtcgagcccgcttgtcggctcgtcgagcaccacgacccgtttctcgcccatgagcgccacaccgatcgccaaccgctgcttctggccgcccgacaacgtcatcgggtgccgttcggcgaagtcgagcagaccgagctgtcgcagaatcccatcggcgcgctcgcgcacccgttgcgcatcttcggccgtacgcacatgctgcatcgcctcgagcagcatctcctcgcgcacgctcgatgcgaacagctggtagttcacatcctgcatcaccatcgcgcacaacgcggagagcctgcccggtttcgccgcgcgcccatcgacgagaatctcgcccgccaccggttcgaccagcccgcacaccgttttcacaaatgtgctcttccccgcgccgttgcgccctatgagccccacgatctgcccggcgaacagattcacatcgcccacctcgcgcacgaatccgcgcttggttcggccgaacaggcgccgccgctcatacccgaccttcagaccacgcgttgcgatcaccggcttctcgccggacggttccgctcgttgcgcgatccgctcgacctgtccccgcggcccgctcagttcgagcgcacgcagaccccatgcacgccgctgggactcgggcagcgcatggaattgttccgcggtgtattcgccgaccacgcgaccggcgtcgaacacaacataccggtcggccagatcggcgacccatgcgagccgatgctcggcgatcacgatggcgatgccgtcgcgtttgagccgcttgaccatgttgcgcaaccgttccatggcctccgcgtccagattgctcgtcggctcgtcgagcacgagcacccccgggtcgagcatcgtggccgccacgaccgccagctgctgttgctgaccgccggaacagtcgacaatgttgcggtcgtgcagatgttcgacgtcgaacgcacgcagccgttcgcgaatgcgacggcggatctcgctgggctccatgcctgcgttctcgcaggggaacgcgagttcgtcagtcgagttcgcatggaaatactgtgttttcggattctggaacaccgaccccacttcggtcgcatagtcctccaccgccgccacgccggcgtggagtccacccacgcgggcctcaccgtgcagactcccccggaaatactcgggcgcgagcccgttaagcagtctggtcaccgtggtcttgccacacccgctgcgcccgacgagcatcacgacctcgcccgcacgtgcctgcagcgacacatggtcgatcgcatgcactccgcgttccacaccgtcagcggattcatccgacgcataccggaacgagcaaccatccaacgcacatcgagtcccgttcatacccctccttgaatatcacagccatcaccgtcattcgcccgccatacccgtgctaggcctgccatggtataagcggcaggcagcacaatgccagcatggcccagtcgattgcctgcatgtgcagcatggcggagctggatgtggcacgtcgccgtccgaggcccttggtgagggcggagacggtgagatcgtgcgccgcattcgccgcgttcatcaacagcggcaccagcacgtattcgagcgagcgcatcgggtggcacagcatggcccagcctcccacattgatgccgcgcaggcgcatgctgcagcgaatcatgcggtagtcacgcgcgatcgtagggaagaaccgcaacagcacgatcgccggaatcaccaccgcatcgggcagatgcaaccgcctcagggcggcgacgagctcgccgggaggcgtggttgcgaatgcgctcatgccggcgatgaggcacggcagcatcattgcgccaccagcggccaacgcccccggcacatgcagccagggtgccgcatctgccacggccgcggcgagccaatccacgcccaggcacatcgcatagcaggccagcatgcccatgcccagcgcgatcttgcccccgcatagcatgggcagcgagaacagcagcactcccatcatgccggcgtacggccccacatgcaggaacatcatcatattggccaccacaagcatggcgagcttgacgcgcgggtcgaagtgcagcacgccgcgggtggcacgaatcggcacgcgagtttcacgtggaacaaccacctccgtcatgccacggccgccttgaggaaatgcctgcgcatcaggcgcatgccgaagaggccgccgaccagcgcgccgatcacaatcgccaccatcgccaccacgaaggtcgtgccgttcaccgcgccaaacagcgcgtcaatgtaagcagcgtccttgcctttgcgttcaaggctggcaatgtaggcgtccttcatcatccacaacggcagaatcggcccggtgcaaccgaaactgaacacgacatagctcagcatgagcgcccatgggcgacgccatgccccgaatctggcaatgcagtccgccgccagcgggaacacgatcgccgtgacgagcgaggtcgcgaagtgacccgaaacgaacaggaacaggccgagcatgagccccatgagcgtgatcgcaccgaatctgcgcacccgagccaccatgagcatgaacaccggcccggcgagcacggccgcgatggcgggcagcagaatgttgccggcaacgccgaacactgccatactcgccaatgcggcgacgcccacgagcgcgaaatagacggcgccgaacacgcccacgttgatcagatcggcaacggtcagacgggtgccgccagcagcccgcacctcacgcctccgcgcatctcgttccatgtcgctcatgccttcgcctcctcgtctcgtactgcaacaccgcgtaacgccgggctagccccgtggcgtaatcgcccgcaccgcggttccgaacgattcacaatgtattgagaatgcgccgcgcgcacaagggtttcgcgaaatcaccggaacaatttccataatccggacacaaatccgagatggcgaggagcttcacgcgaatccttgagcagaataacgctactatgtccgtagcgctacgtataccgtatctctgagaagtacacgcaccccaagcggaaggaggcgaaagaggagtcatgcgcaacatatggttcattctgcggcgcgacctcaagcgactcatcatcaatccggccgcctgggtgatcatcttcggcctcaccttcattcccgcgctctacgcctggttcaacatcatcggcttctggaatccatacggcaacacgaaaggcatcaccgtggccgtggcgaacgaagacgccggcgccgacaacgccatgatgggcaagctcgagctcggcgaccagatcgagagcacgctcaaagagaaccacgagctcggctggaccttcctgggcaaggcgaaggccatggaatgcgtggaatccgggcattgctacgccgccatcgtgatcccgcgcaacttcagcgagaacatggccgccgtgatcaccggcagcggccaacgccccacgctcgaatactacgtgaacgagaaagtgaacgccgtcgcgccgaaaatgaccgacgtcggcgcgaacaccgtggaccgccaagtgaacagcgccttcgtctccaccgtgagcaaggcggtcaccgacacgatcaacacaacgaatgtgcagatcacacaggagggcaacgccaccgtggcgcagaccgtggcgaagctcgacgccacgaaggccaatctgagcaaatcgcgcacgatgatcgccgatctgcgcaagacactcgacggcgtggacgagaagaccacggccgccaaacaggcgctcgccggcgtcgactcggccgccacaagcgcctcccaaggactcaccagcgcatccggcctgctcacgaaaacgcagggcggtatcacctcgttcagcaacgacctgtccaccgaactcgaccaaggcggcaatctgttcctgcaggcgagcggcaaggcgagcacatcggccacccgtgtcgccaacggcgtgctcaccgcaagcggggccaccggcagcgcactcaacgaactcaccagcgtgaacaagacgaacgcgcagatcctcgctgacctcaaagcgctccccgacaacccgctgagcgagcagatcaacgagatcgtcaccgacctgagcgccgagaacgaaaaggtcgcgcaaacactgcagacgctcaccaccctcaacgactccaccaccgcagccgcgaacagcacgctcggcacggtcgaccagttctccgcgacgtcaacgaccacggtcgacgcgctctccggcgcacgcaacacgatcaattcgagcgcgataccgcagctcaattccggactcgccacgctttcgggcaccgcaggcacgctctccggcttcctcaccggcacacagtcgctcaccgggcagacgaacctgatcctcgaccagctcacgcagatctgccaatccacctccagctcgctcaacagcaccgacgacctgctcggcaagttcatcacacgcatcgacaccgtgaccaccgatctgaagacgctcgagaacacgaacgtgctctcggacctgctcggcagcaagaacggcacactcgacgcctcgcggatcgcctcgttcatgctctcacccaccgtgctcgacacgcatacgctctacccgatcgacacgtacggatccggcatggcgccgctgttcacgagtctggcgctatgggtgggcgtgttcatgctcatggtgctgttcaagctcgaagtggacaacgaaggccttgaaggacgccatgtgacgacgaaccagacctacatggcacgctacctactgctggcgatcgtcgccggactgcagggcatcgtatgcgcggtgggcgacctcatcatacgcgtgcaatgcgcgaaccggttcgtcttcatactcacggcatggctcacctcgctcgcttacctggccatcgcctacgcgctgtccgccacgttcatgcatgtgggcaaggcgctcgttgtcgcgctcgtcatgctgcagattcccggcgcctccggcctctaccccatcgagatgatgccggacttctaccgcgcgctctacccgttcttcccgttcacctactcgatcaacgcgttccgcgagacgatcgccggattctacgacggcgactggctgacgaagatgctcatgctcgccttgttcacggccatcgcgttcttcgtgggactcgtggtgcgcccctggctcggcaatttcaaccacctgttcgcccgcgaggtgcatgagggcgacatgatcgtcggcgagcgcgtgtacatgcccgccaaccgcttcgacctcgcgcaggcgctccatgtgctcgccgatcacggtgaataccgcaggcgcatcgaacgccgcgccaagcgtttcgccacactctacccgcggctgatgcgcggcgcgctcgtggccggtttcgcggtgccgatcgtcctgttcatcgttttctcgttcgtcggcgcctccgacggctcgaagctcgtggcgctcgccacatggatcgcgtggattctgatcatcatcatcttcctgatgacggtcgagtcgatccgcgaatcgctgcgccggcagaccgagcttggctcgctgagcgaggattcgttgcgtgacatgatcatggcgcagggcgtgttcggcaacaaccggcaccacatcaccgtgccggcggacgagctcaggccggacgcggcgagcaacagccgcgaacgcgccgagaagaggcgcgaggagcgcgatctgaaccatcgggaagatacgctcgacctcaatctcaacgaactgcgcaaaccggaacggcagaggaagcaccgcgggagcacaagccggcgcaaccaccacgacgggaggcactcggcatgagcatgctcgcgaagatcttcgccgatgacgtgcggcacctcaccagcaacatcgtctcgatcatcatcacgatcggcctgatcgtgatccccggcctgttcacctggttcaacgtggcggcctgctgggatccgttcgcaaacacgaagaacctgcagttcgccatcgcgaacgacgacgaggggtacaagggcgacctgctgcccatgcgcatcaacatcggcgagcaggtggtggacacgctgcgcgcgaactcgcagctcgactggacgttcacgaaatcgagcgcggaggcgatcgacggcacgaaatcgggcaaatactacgccgccgtggtgattccgaagaacttctcgaagaacatgatgacgttcttcaccgatgacgcgtaccacgccacgctcgactactacaacaacgagaaactcaacgcgctcgccccgaaggtgaccggccagggcgccgacaccatcgccgccacgatcaaccagacgttctcgaaaacgctcaccgacaccgcattgaatctggcctcgtccatgctcgacatgctcgacaagcccgaataccagcagcggctcaagtcgttcaacggcaacatagccgacctcgcgggcatgctgaacgacagcgcggcggtactgcgcacatactcgtcgctcaccgactccgcgaaaacgctgctcgccagctcgaacaagctcatcgccgacgcgcgcgcatccgcgaaaacgggagtcgacgatctctccgccgccaaaaccggcgtgagcgacctctccggcgcgctcggcacgtcggtgaatgcgctcggcacggcgatcgacacctcgaaaacgagtttgggcagtctgaacgaccgtgtggacgagctgttctcggcggtcgacaagcaggccggcgacacgtctgcggcaatcaacaacctcgccggcaacgtgcgcaccgaggcgacggcgtacgcgaccacgcgcggcagactgcaggaactgctcgacaaatccgacaatctgggaccggtggcgaaatccgccgtgcaggcgttcatcaaccggatcggcgcggtggccgacgacctcaaccagactgcagaccgtctcaccacagccgcgaacgacgtcgactccaaggtcggctccagcaaggagacccggcaggaaatcaaggatctcgcaggcaaggcgcaatcgtcggtctcgtcgatctccaaggacttcgacgagacgatcaagcccgacctcaccgcgatgacgaacgcgttctctgacgcggcgaactcgctcaacggcaccgtcagcacgctcgactcctcactcgacagcctatcgggcacggccagcgacgcgaacaaacagctcgactcggtgcacgagctcatcgacaacgcggccacccagctcaccgacgccgcgaaggagctcacgaacttcaacacccagttcgccaaggcactcgacaccggcaacatgggcaccatcaaaaagctcctcagcggcaacaccgccacgctgagcaccgcactgagcacgccggtggagctcaagcgcgtcgccctgttcccggtcgacacgttcggcgccgcgctcacgccgttctacacgttccttccgctatgggtgggcgcgctgctgctggtggtcaccttgaagatcggcatctcacgcaaacgccagcgcgaactcggcaacccgaaaccatggcagatcttcctcggccactacggggtgttcgtctcgatcgcgctgctgcagagcacattctcctgcgcgggcaccctgctcttcctacgcgtgcaggtggtgcacccatggctcttcatgttggtggggtggttcagctccatcgtgtactcgttcttcacgtacacgctcgtctccacgttcgcgaacgtgggcaaggcgataggcgtgctgttcctcgtcatgcagatctccggttcgaacgcggcctacccgctctcgattctgccgcatttcatcagcgatataagcccatggctgccagtgagctattcggtcaccgcgatgcgtggggccatcgccggcatctacgaaaacgactactggatcgccatgggcaaactcgccctgttcctcgtgccgctgctgttcattggcctggtgctgcgccacgccctgctcggcttcaaccattggtatgaagccagggtcgagcgcaccaagctgttgggatgaggtgacgccatgcattccatttcctccgcttcctccgcttctgcttccgccgcgcgcgctgcttcctccgctcgcgcccgcgccccccgcccggcgcttggcattccgcggcatgggctgcgccgcgagcgcaccgacggcaagatcacgcgcgccgtgctcgagctcattctcgcgaaaggcattggcgcggtctccatcgaggccgtggccaaaaggtccggcgtggcgaagaccacgatctaccgccggtacgcgaacaccgacgacctgctgcgccacctctcggtcgccgtgggcgagccgctcgatttcagcggattcgacaccacgttcgacgggttgcgcggtgtgctcaaatgcattgtcgactgtttcgacgaggaacttggactcaaggcgatcggcgtcgtgctgtcgtcgagcaacgactacctcgcgaacctcgccgagcgagtggtcacgcccgcccagcagcgcttcgccgatttcattggtcgcggggtctcctctggcgcattccgcggagatgtgagcgtgccgttcctgttccagacggtcatcggatcgatgatggccgccaaagcgctttcagattcctcccacgacacctgggcgcacgacatggcctccctgctgtggcccacgctcgctgcccgatgaccattgcgcagtccatcccacggaatctgccgcataaccgaccgccaatcgcccccgccgcggcactgcttacggaaccatccgcgcaacatgccgcagattgccatctccgcggtcatcctcttggaatcttccgcataacagaccgcaaagcaatctccccatgaccgaggccgcaaaatcctcagaaaaccaccgcagacgacgacgcggaatttgcatccaatacagaagcggcatcaatctgcacactattctctaaaaatatcaatacagcaaaattacttccgcatttttataaaaagataaaccatttaccaaccattaacgttctgcgaacatctcgtaacgagcggcagataatctactctgcagattcacagaattgcatatataaatagacaatcgtataactaaaaattctatggcagatctgcccatgcgctcaccgatcgtatgatcgaatggcggtcacagcaccgtccgttgcaattcgcgaacgtgaatcacaccagcttgactcgcaccacaccttcaatcaggggacgaaaggcattcgggtccaagcaagagaggaaacggcgattcaaatgaacaagcccaatcgaaagacatggcgcaccacggccaccgcaatggcggcgacggcagtgctcacattgtcgggatgcggcacgggaacagccgacagctcggcaaatgcggcggaagacaccttcgttgcgggcggtctgttcccgctcaccggaaccgcggcatatctgggcccctcgaacgtctctaccatgaagctcgccgagcaggacattgacgaagcgggcggagtgctcggcaacaagatcagcaccatcacggccgacacctcggacgcggagcatgcggaccagaacgcaacagcagtgcagtcggtactttcgaagaacccgtcggtcgtcattggcccgccgttgagctcggtcgtcaagaacacctataagcaagtgacgacgtcgaaaatccctatgatttcgccaggcgccacatccacggcgttctccggactcgacgactacttcttccgcacgatcccgccggacaccgtgcaaggagtcgtcatgggagatctcatcgcacaggacggcatcaaaaatcttgccatcgcggtgttcaacgacgagtacggaatctcattgcgcgcagaagtgctcaaaaccttgaaagaaggcggggtgaacgtcgtgtacggcgagacggagaccttcgacccggccgagaacaacttctcatccatcgccacgaacatcaaggcgacgaatccggacgccgtgctggtcatagcggcggaccagacgatcccgctcgtcaaggaactggcggccaagggcatcgacacccataagctctatatgcccgacagcaatatggtcgaccactcgaaggatttcaccagcgggctgctcaagggttcgaaggggacgattcccggcgcacaccccacctccgagttccagaacgcgctcaagaccatcgcgcccgacacgacgatctacacctataacaccgagacctacgacgccatggtccttgccgcattggccgcggagaaaggcggcgcggccgacagcgagacggtgcagaagaacctcatggccgtttcgggtaccaccaaaggcgagaaatgcgaatcttacgaagactgcgtggccctgatgaagagcggcaaggaaattcagtacgtgggcaagacctcaatcggcgtcttcaacaacgcccacgacccgagcaccgcatcgattggcatctatgagtatgacgacagcaatgtgccggtcttcttggattcacaggagggcgcagtgccgcagaattagttcgcgtcgcgcccggcaagctgatcgggcctgcgcatacgctgaaatctgcggtttgttttacggaaccttccgcacaaccgaccataaactgctccctacgcggtcaatctcacggacgcttccgcatagcagaccgcagaaccgcagtttcacggcatgtttcacggagtcttccgaaaaaggagccaagaaagcacccgcttgcggccgggtcttcggaagcgtccgcgcaccggaccgcggcggggtctgcaaacgacatggattacgaaaaacccacgcaatatgccgcgcatctgcgaaacagcgcaggaaatcgacctggctcaatttcacagcaaactctcaggatgctctatattagcctcaagcattgcaagtctacaatataggcatcagctcaagagctgaccccttctttcttcttctcttctctctggaaggccggcggcacacgaaccgccggccttttctcttgcttgcagatcataggccatcgcactggcagcacgagcagcgaagacgcagagaaaatggtcttccttgcaataccaccctcaacacagcacacgcagaacgcgtcatcatgccacccttgcagtttcaatctcaacacagcacgcatgcagcacaccaacgtgccacccttgcaataccaatctcagagcagcacataacaagcggatccacgtgccgcctttgcaggcataatctcagattgactatctaagatgcctgaatatgctcacgtgaggccgggactgcaaagcgagccatcctggagcgcacagacgtgccccttttgcaacttcaatcccgagcaggcactccagaacactgtgacatgccccttttgcaaccatgacctcatagacacacgcgccaccaacgcgagcgctggcatcggcaacaaacgcacgcgtcaccaaaaccagcgtcggcgacagacgcacgcaccacccgccccgcgcccgcgccaaacgcacgctaccaacgccggcgtcgacgcccgccgagcgcataccggtacacgcagaacgcgccgagcgcgaacagaatcgccggagcgagcgacgaaaccgtggcgaccacaccgtcaagcgtcgtgggcatttgcagattcgcccactcgttgcggaaatatccccacagcatcggcatgctggcgccgagcagcacggcgaccacataccagcggattgcgcgccgcgaacgctgccgccacagcagcgcgccgcccgccgccggactcagcacgaaactgctcacgccgctcaccggggtgaacagcgagtccgcgcccggcagccaggtcacatggcccaccaatgccatcgacgccgcgcacagcaccgcccacgtcaccaatgttcggttgcgccggtagaaccgcctcagcgcgcgcatgccaacacctcacttcacttccgcttgccgaacgccaaacaccgcgacgcaatcggcggcgcggcgcacatattcgcccatattgtagcgtcagtgggcggcttcgtcggcgcgcatctcattccagtcgatccggcgatctttgaaatagtattcgcggtcgcgctcgcccacttcgcgcagcacatggcacggattgcccacggcgacgacgttcgacggcaggtcgcgcgtcacaatgctgcccgcacccaccaccacgttgtcgccgatcgtcacgcccggcagcacgaccacgcccgcgccgatccagcagttctcgccgatgcgcaccggcatgttgtactggtagccgcgctcgcgcagttcgggcagaatcgggtgcccggcggtcgcgagcgtcacgttcggcccgatcatcgtgtgcgagccgacatagatatgcgtatcgtccacgcaggtcagattgaagttcacgtagatgtcgctgccgaagtgcacgtgcgccccgccgaaattcgcgtggaacggcggttcgatgtagcaggcgtcgccgatctcggcgaacatgtcgtgcagcagttcggcacggcggtcgagctcgtgcgggcgcgtctggttgaaatcgtagagccgctcaaggcagtcgaactggcgcgcgagaatctgctcatcgtgaggcaggtacatctcgccggtgtgcatgcggtcttccatgtcgctcatttgctctcctgacacgtctttcgtacatcgttgtcgtcgacaccattgtattgggctgcccgctagtctggcactatggattcgctgttcgtgaggaaacattgttggcagattatcggcgcgctgagcctgatcggcgcgctgtggttcacgatcgcggtgtgccggttccacatactcggcatggacaccgcagtatacggctggatcaccgcgcatgtgatgacccccggcatgaccagcgtgatgcgcatgctcacccagctttccgggtcgatcaccgtgatcgtcgtggcggcggtcgcgctcgccgtgctggccgtggtgaagcgctggaaaatcggtgtggctgtggccgtcaatctcgcgggcatttatgtgctcaacgagatcatcaaacacattgtgcgccgtccacgcccggatttcccgcatctcgtgttcgagcaggggtacagtttcccttccggccacgcgatggtgagcacggcgttctacggattcatcgtctacctgctgtaccgctactggcacaccgcgcgcgattcgggcgcccgcgtggggaagatcgtcgcaatcgtgctgctgtgcctgatcccgccggtcgtcatgttcaccagggtctatttgggcgtgcattacgcgagcgacgtgtgcgcgggcctcctgttcgcaatcgcctggctcacactgttctatgtgccggcgatgaagcgcacgctgctcaaacgcgcgtctccggctgcatccccaacgaaacgctgagccgcacatctgcgattgaagtcgattgcagattggccgccgcggctcggctatctgcagtcgcgccattatctgcaagcgcgccatccgctcggctatcgcacactctgccgggcgccgttttcgtcattgcgccgcgcgaatctgcaacaatgacgaaaccagcacccgggtttcgtcatctgcgcggctttttgcgagccaatgacgaaactgatgaccagatttcgtcatatcgtcgcgttttcccgcgcagattgacaaaaacaccagcgcatccgcttgcctccgttgcctccgttgcctccgttgcctccgcaaggtacactagcaacggcagaacagactgcacaacgccggagaacggggcgaacatgggcggcaaatcttccgggcagggcaatgacacaccacatgacgcggcacagcatggcaccacacaacacagcaccgcgcatgccgacgatttcgacaccatgcacgccgaattcgcagacaccgcaactggctccgccgcggattccgctgcatacgaaccaaccgcgccccgcaaacgccgcaacgccgtcatcgccattgcagtgactgcgctcatcattgtcggcgtgcttgccgcgatcatcattccaatcagccgcgccaaccaccggcatgccgaggaggagcactccgccgcgctcgccgactgcgaatccgcgcaacgggaattcgccacgctcaacaccacgtacacggtcacgcttgccaacgccggcaagctcgcgaaaggcgacggcaaaacgatcagcgaggatcatgcgaccgcgctggcaagcaaaatcgagcacatcgacgacacgcatacggtctcctcgctcgtgaaatccgaatgcgacaccaggcaaagcaccgacgacctcaacgagctcacccgcagattcggcgccgcgagcacgagcatggtcaaccgcatgcgcgacgtgcagaccgacgccgacacgctgcgccgactcgtggagggcgcgcgcaactcgaaccggcgcggcgaactgcagaagcagctcaccattgcgaaggccgcatacgaacgctcggcgaacaaggcggccgagaatctgcgcgccgcattgcaggcgcagatcgccaacgcgggcgcactgctcgaaccgggctccacggctacgaatccgcaggtcaacgatgcgctcggctcactcaccgacgccacgaacgcggtgatcaacgcgatgccgctcgactgcgaattcgccgcctgcgtggccctcaccttcgacgacggcccaaacaagcagatcaccccgcagctgctcgccgcgctcaagcaggcggatgcgccggccacgttcttcgtgcagggccagtttgtctccggcagcaacacacaactgctcgcgaatatggccgcgcagggcaacgaaatcggctcgatgagctggcgacacaagcagttgcacacgctctcccccgccgaactcaccaaatggttcaacgacaccgatgacgtgatcgaaagcgcgggcgcgggcaagccgacgctgttccgaccgccggacggcgcgtggagcgaagatgtcgtcgacgccgcgaaacgcagcgggcagtcggtgattctgtggaacgtcgactcacgcgactgggacgcgcaggcatccgccgccgacatcgccaaaaccgtgctcgatggcgcatcgtcgggcgcgatcattgcgctgcacgacggcaacgagcgcacagtcgaagcgatcccgcagattgtgagcggcctgcgcgaacgcggattcacgccggtcaccgtctccacgctgctcgatggcgaactcgaaccgggcaccgtgttctatgcgcgaggcgacaccgcgcaggacagcgcaccgtccgacggtgtagaggtcacccagtgagcccagatgcagtctactgcgcgagtgtgaactgcgcgttgtagatgtcggcgtagaaaccgtgcttcgcgagcagttcctcgtgtgtgccacgctcgacgatgtcgccgtcgcgcatgacgaggatcatgtcggcgtcgcgaatcgtggagagccggtgtgcgatgacgaacgacgtgcgcccttcggtgagcttgtccatcgccgtctggatgagctcctcggtgcgcgtatcgaccgagctcgtcgcctcgtcgagaatgaggatcggcgaatcctgcaccatggcgcgcgcgatcgtcagcagctgcttctgcccctgcgacaacgtggccgactcgtcgagcacggtgtcgtagccgtttggcagcgagcggatgtaacggtcgagtcccacggcacggcaggcggcgaccacctgctcgtcggtcacgtcttccttcgcatacgccacgttctcgcgcacggtgccgttgaacacccaggtgtcctgcagcaccatcgagaactggtcgtgcacgttccaacgcggcacgctcttcgtgtcgatgccgtcgatcgagatcttcccgccggcgatctcgtagaatcgcatgagcagattcaccatcgtcgtcttgcccgcgccggtgggccccacgatcgccactttctgcccaggctccacgtccgccgagaaatcgtggatgacgagcttgttcggctcgtacccgaatttcacgtgctcgaagctcacgcggccttcgacgggcgtgatctcgccgttgctgccgtagccgagcaatggctgcttgtcggactcgtcggcgagctcgggttcgtcgaggaaggtgaacacccgttcggagcccgcggcgcagcgttgcagattctggaacgcctgcgcgaactgcgagagcggttgcgtgaacaggcgaatgtagagcatgaacgccacgatcacgccgaattcgatcgagccgttcatcgcgagcgccgcgccgaccacgcacacgacgacgtagccgaggttgcccacgaggttcatcattggcatcatgaggcccgagatgaactggctcttccatcccgagtcgtacaggtcgttgttgtagcgttcgaatctgcggatcgcatcggcctcgccgccgaaggccttgaccacggtgtgcccgctgtacatctcctccacatggccgttcacgtcgccgagcgccatctgctgcttgacgaagtacttctgcgagaacctcatcacgacgagcatgagcaccatgccgagcagggtcgcgcccactgcgcacaatgccaggatccagttgttcgcgaacatcatgacgagcgagcccacgaacagcgtgaccgacgagatgagcgtgccgagggactgcccgagcgtctggcccaccgcgtccacgtcgttcgtgatgcggctcatcacgtcgccggtgctgtgctcgtcgaagtatttgagcggcagcttgttcatcttcacgtcgatggccgcgcgcaggcgttgcgccgtgcgctgcgtgacggtggccatcatccagctctgcacgtatgagagcagtgcgtagcccacgtagagcgccacgagcgtccatccgatgcgcgtcaccgcggtcatgtcgatcgaacgcagcaccggcttgccgtgcacgagcgcaggcagtcccttggtgatttcgtcggtcatatcgccgaggtagtccggccctatgatctggcagatcgcgccgccgacgccgaggatcagcgcgatgacgatcgccggtatgtagcgcttgctgaagcgcatcagttccttgagcgcgccgccgaaatcatcggctttctccacgggcgcgcctgcacgcccatgtcccattggtcctggcatatcctcacatcctatctatctcaaacccatacatgtgcatacggcattcgccgccccactcacgcactgagctcctcctcgctcagctgcgatttcgcgatctcctggtacacctcgcaggtctcgagcagttcgcggtgcgtgccttgacccaccaccttgccgtcctcgagcacgagaatgcagtccgcgtccatgatcgtgccgacgcgctgcgccacaatgagcttcgtcgcgtccttcgccgtctccttcaacgcgtcgcgcacctcgcggtcggttttgaagtcgagtgccgagaacgaatcgtcgaagatcagaatctccgggtcgcggtacacggcgcgcgcaatcgacaggcgctgtttctggccgcccgacacattcgtgccaccctgggcgatcggcgactggaagcctttcggcatcttgcttacgaattcggtggcctgtgcgatgtcgctcgcctcgcgcacgcggttcgcctcctgcgcggtgagctcgcgcgcctcgccggccttgaggaactcccgttccgccttgcggccgctcatgcgcgagacgtcgatcactggcacgtcctcgggttcgtcgggccggtcaccgtagctcacattcgattcgacggtgcctttgaacaggaaggagcgctgcggcacgtagccgatcttgtcgcgcagtgtcttcaagtcgtattcgcgcacattcacgccgtccacgagcacctcgccgtccgtcgcatcgtagaagcgcggcacgagattgatgagcgacgacttgcccgaaccggtggagccgatgatcgccaccgtgtctcccctgttcgccgtgaaactgatgtgttcgagcatcgcctcgcgcgaatcggggtaggtgaagctcacgtcgcggaattcgatctcgccggcgagctcgaggtcgtcggcatatcgcgcacgttccgctggcgtgatgattccgcgctgcttggcctcctgcaccgtgagcccgcgctccgcggtgccggacttgacgagcgggtcggtgtcgagcacttcgagcacgcggtgtgcggagacgtcggcgcgcggccacagcacgaacaccatgctcatgagcaggaagctcatcaccacctgcatggcgtagctggagaacacgaccatgttcgagaacaacgtgagtttgtcggtcaggccggcgtcttggatcaggtaggcgccgatccagtagattgcgagcgacagcccgttcatgatcgtgcccatgagcggcatcatcaccgacatcgcgcggttcgtgaacagctgtgtgttcgtcagattgctgttcgcccgctcgaacttgccttcctggtagtcctgggcattgtaggcgcgcacgacgcgcatgccggtcagattctcgcgcgtcaccagattgatgtcgtcggtgagctgctgcattgccttgaacttcggcatgacgagcaccatgagcacggcgatcgagatgatgaggatcgccacagcgatgccggtggcgagcgtccattcgaagccttcgccggcgatcttgcacacggcccagacggccatgatcggcgccttgatgagcatctgcaagcccatcgtgatgaacatctgaatctgcgtgatgtcgttcgtcgaacgtgtgatcaggctcgccgtggagaagcggtgcatttcggacggcccgaacgactccaccttgcggaactcgagcgagcgcagacgctggccgaacgatgccgccacgcgcgcggcgaagtagccggtgatcaccgcgcatgcgagcgagccgagcgagacgagcagcatcttgccgccggcgatccagatgtcgcgcatctggctgcccggcgtctccacgagccgcgtgatctgtgacatatagcttggcagttcgaggtcgaagtacacctggcccacaatggtgaccagcgacaacaccagctgccctatctccgttttggagagatatttcatgattcgtatcatatttttccttacaccgtaagcttttttctcaaacagatgatgtgcggattctggagctgcgcacggcgtccttattgcacgggacggtcgacgtcggcgtcgttcgacgacggcgcatcatgcggcctgcacgagccatgccattgctcgccattgcgcaccatctcgcgcatacgttcgtggagtcgggcgcgacgttcgaacgcctcctcgacctgttcgacggtggggtaagagccatccggctcgcagatcgacaagtaggtcatgaattcggagagcaggcccacgaattcgcgcgtgcggcgctctcccatctgcgagaagacccacgacaggttctcaatgagacggtcgctgcgctgacgcacagcacgtcttccctcgtcggacagctcgacaaccacgctccggcggtcctgcggatcacccgtgcgcacaatccagcccttcttcgtgagactggccagaatcgacgagatgcgcccactcgtcgcgcccatcgcctgggcgagctgcgacggcgtacgcgcgccttggaacgagagctcgcggagcacgaacatctcgccctgcgcaccgcgctcgaatgaacgcgtcgccttcgagcgtgacgcccacatcgcgaacatcagttcgtgcaccgcctccagttggtaatccatagccgctccatacgcaaaacacaatttgtcttacagggtaagttacttacagtagaagacaaatttcattcaaggatcaagaggaacggtcagggaatcgaggagagcgcggtgacacgcctccgggctcggcatgaggccacactcccacgacaacgaattgcaggtaagcttttagcatgttttcaccgtttgtcaaatttcgctgaaatataaccgccaatactgaaaaaatgggttcggtattcttctgtggcgagtcttaagtcataacattcacgtgttgtttcagggaaggcttctatgggcacgcaaaccgcatcgaacagtgaaggacggaatccgatcgtcgcccgtgcggtcgatctgtgcaaacgctatggcaaaggagacaacagcgtcatcgccctcgaccacgtcaacgtggagttcaggcgcaaagccctgacggcgatcatgggtccctcgggttccggcaaatcgacgctcatgcactgcatggccgggcttgacaccccaccagcggccaggtgttcattgaagacctcgaggtctcctcaatgggccaacgcgagctcacgcagctgcgtcgcaaggagatcggattatcttccagtcgttcaatctggttcccacgcccaccgcgaaggagaacatactgctgccactgcagattgcccaccgtcccatcgatatggattggttcgacaaagtggtgtcggtggtcaagttgcagaaccgtctcgaccatcgcccgagccagctgtccggcggccaacagcagcgcgtcgcctgtgcgcgggcgatcatggagcggccgagcgtgatcttcgccgacgaaccgaccggcaacctcgattcgcggtcgagccatgaggtgtttgaattcctgcgcatgtgcgtgcgcgaatacgggcagacgatcgtgatggtgacgcacgacccgcgtgccgcgtcgttcgccgaccgcgtgctcgtactgtcggacggcagcattgtgcaggacctcgaccatccgtcgtacgacgacattctcgcggtgttcgcgcaggacgacgacccgcagaacggtccggtggaggtggagtctgcaacggcaaggagcgcggaacaatgattcgcattggtctacgcgatgccaaagcgcattttcaccgcctcgtgatgtcgatcatcgcgattgcattgggagtctcgttcgtggtcggttcgttctgcttccgttccatgctgaacgaccaggtgacgcagctgatgggcaccaattcggatcacgacgtgtatgtgcgcggcaccaccgaagaacagaacgacagctccttcgccaccagcgggccgatctcaagcggcacgagctacaacaagatcgatacgagcctcgtcacccagatcgagcaggtcaagggcatcgacaacgtaagcccgcccgaacgcacgataggtgccacgctgctcgaccatgacggcaatgcagtggtcaccaccggcgcgccaacgctcatgatcagcgcatcatccgaacacccttggcgcgccgccaatttcatcgccggcacctatgccaccggcgagcatgagatcgccctttcccaggacgccgcgaagaaggcgggactccaggtcggcgacaccacgcggctcatcgtcaacggagagccgcacaccatgaaggtgtcgggcgtcttcaccacacagaccgccgaactcggcgtgctgatcattctcgcacagccggcgctggtcaatcagctcatgcagttgcagggcgaagacacctccaaagtagacaagatcggcgtatacggcaaccgcaccaccccactcacggttcagaagcaacaccagctcgcggaccgcatcaacaaggcgctgcccaaggattccaaggcccatgcggtcaccggccagtcggtgcgcgacgaggccacgaaaagcacgcaggagtcactcggcttcgtccagccgctcattctcatcttcgcagtgatcgccctcttcgtcggcgcgttcatcattgcgaacacgttcacgatgatcgtgcgtgattccatgcgcggctatgcgctgctgcgctcggtcggggcctcccctgcacaggtgttcttcagcgtggtcattcaggcgctcattcttggcgtcatcggctcggtgctgggcgtgctcctcggctgggggctcatagagctcatcgactggggcctgagcaagggcggcttcccgctgtccggttctccaacgccttcgcctacggcagtcgccgtcggcttcatggtgggcgtggtggtcacggtcatcggctccgccattcccgcgcgcaccgccgccacggcaccacccatccaggcgatgaacgagacgatgaaccccgagaagccggtgacggcacgcggttggatcggtgccggcatggtggcgttcggagcactgtgctggttgttgtgctggctgctggcagccaagaaagtctcatgggcatggctcaccacggtgggcacgggttggctgctcggcttgggcggcgtatgcacggcgggtggcgtgatcgtgctcgccccggctctggtgacaggcgccgccaaggtgctggggtggctcccctctcgcattcccggtgaccggcacgctggccacccgcaacatcggccgcacgaaacgtcgcaccgccaacacggccgccgccctgttcgtgggcgtggcaatcgtcagttgcctgagcgtgctcgcctcgtcaatgctcgcctcggtgagcgatatgatcgacgacaatcttcatgccgactatgtgctcgtctccgccgcgctctcgcaatccgtctcgccgaaggccgtcaatgacgtgaagcacacggccggagtcggcgcaacaacggcggtgcgcacactgcccaccgtcaagctcatgcaggcgaacgagcaattcaccgccatggcggtggaccgcgaactcctcgatgccatgtacccggccacccatcaggaaggcgatgcagcgcaggccatcgagcatggcgagatcgccgtcggacgcaaggtcgcagactccaacgggtatgcaatcggcagcaccgtggaaatggagtccaagaacatcggcatcgacgaagcggccaccaagcaggccatcgcggcatatgaacagcaagtgggcgagcaggtgtcggtacatcgaacgggcaggtacgtggcatgatcgccatagaatcggtgattctctcggtgttcggcaccgtgctcggcatcctcgtggggctcggcgccggcgtggtggttcgccaggcgtatcgggacaacggtctttccaccatgagcatcccatggctgcaactgctcggcttcctcggcgcggccattctcgtggggttgatcgccagcatctcgccggcaagccgcgcactcaagaaaccggtgctcgaagcggtggccagcgactgatcagccgcgtgctacgcgtgcgcatcgcccgcggaatctatggactgcttgagatcgcggttctggaagcgctcatgcagcacgcagtagccaccgaacaccacgagccacaccaaaccggcgatcgccggtccgcgggtgtctgccccaatgaacagcgtgcagtagatgaacacgaagaacgcggtggtgagcgggttgagcacgcggtacgccggcatgcggaacccgttagccatgaactgcggcgaattgcggtaacggtagtgcgcgatcatcgtcaatatgtaaatgaagatgatcacggccgacgacgccgacgagaacatgacgaaagcgcccgagacgcgcgggatcatctcgatgaccggcgagagcagcacgaggatcgccgatgcgatgatcgcgcgcgccggcaccttcgtcttcgagacgacgccgagtttcgcaatcgcaggcgacggggaatcctcggcgatctcatacagatggcgcccagccgaatacagcagcgagttgagtgacgaggcggcggccgtgaccaccacgaagaacacgagggcggccgcccagttcgcgcctgcgtattcgaacaccatgatgaacggcgaggcgaaggagccgtctttgttcgggcggaagttgcgccacggcacaatcgtcatgatcgccagcaacgcgcccacgtagaagatgagcacgcgcacgatgatgccgttgatcgccttcggcagcaccttgcgcgggttcttcgtctcggagacggtgacgcccatgaattcgatcatctcataggcgaagaagaccatctggaagctcatcagaaacgccagccagccattcggcgcgagcgagaatccacgggtcagattgtcgagcgtcacactgccggccggcgacacatggtcctgcccgggcacctgcacggcgttgtatttgaaaccgcagacgagcatgatcacggccgtggcgatcatggccacgatcagcgtgatcttgatcatcgaaaaccagaactccgcctcgccgaacgccttgacggcaatgagattgatcatgacgagcagcagcaggaacccgagttctatgagccccttccacgcggagacgtcgtacccaagcgtgcggaagaacgtgacgcagtactgccccacggcggtgatctcggtcatgcctatgagaatgagcacgatccagtacgaccacagcgcgaacttgccccatccgtcacccagatagaagcgaatgaagttgatgaacgtgtgctggctcgggtcgcggtacatcagttcgccgatcgcgcgcatcatgaggaacatgatgccgcccacgagaatgtagacgaaaatgatgttcgggccggccagattgatcgacttgccggagccgaggaacaggcccgtgcctatcgcaccgccgatcgcgatgaactgcacgtggcgattgctcaggccacgttccatctcgttgtctttgtcgagcgtctcgagcgaggcgttcacttcctcttcgtgaggggtctcatgaggttccgctggttgctgcacatccgacataatatttccgactctagcaggcatccgttgcacatcgcgttcgcacaccgcaaactattcgacggacttaagcgagctgacggggtcgatgcggtcgagcaccggattgacgaacagctgcacgagccatgcgaatgcaagcgtggccacaacggtgatgatgtagctccaccacgagatatgcacctcgaagtagattccgggcatgttgagcgcgttcgtgagcaggcccgacacccatctgccgagcggcaggcctatgacgatgcccatcacggtgagcaccatcatttcgcggttcacataatggtgcacctcgcggccgtagaacccgagcaccttgagtgtggccatctcacgcaaccgttccgaaacgttggtgtgcgcgagcgtgaacagcacgacgagcgcgaggctgcccgcgagcgcgacaatcaacgccacgaccgcgcccatgaggtcgaatttgaaatcctcggcctgctgtgcgcacgaggtggcgctcatgacggtcgcctcgttcttgaggtgctgcacgtattcgctttgctcgctgtcgcttcctttgagcttggcgtagacggcgttccaggtgattgctggttccgtgccgccatcgccggcctgttgcgccgggaacagctgatggtagaggtcttcggagatgaacgcctccgcgccgatcaagctgcgggtgacctgcgccaccttgaccttgtgcggctgggtgccgtcgccacgcaatgtgacctcgctgcccgccttgatgccaagcgactgtgccgcggactgggcgacgatgatgccgctgttgtcgaggcgcaccggctggtttcggttgccgccatgcacccagccgagcagggaatcgccctgcgccggctgcagatcgaacatcgtgttgagctcgcccagctggcgttgcggcaccacggtcaactgaacattcgtgcctcggtcattggcattggtgatctcgccgttctcgatgcgcgtctccatgatggccgtcgttgtaccgtcggagacgagtttctttctcaatgcctgttcgtcgccgtcgttggccacggcgagcatgtcgtattggtccacgccacggtactggttgggcccgagtgcggccaccgtgtcgttgatggccagaccgcacaggatcaacgcggtgcagccggccacaccacccaccgtcatgatgagccgcgccttgaaccggaagatgttgcgtgccgtcaccttgttcaggaagctcatgcggctccagagcgggcgtacacgttcgagcagaatacgcgagccggccttcggcgccttcggtcgcatgagggcggccggcatctggcgcatctcgcgcaccgaggcaatgagtgccgctccgagcacgcccaccacgaacagcagcacgccaagcgagccatagagccagtcatattcgagccgcaagtctggaatcgcgtagagtccgcgaatcaccacgagcaggaaggcgggaatgccgaggaagccgatgagcagccccaatccgccgccgatgaggcatgccagcaacgcgaacagagcgtagcgcaaggtgatggcgatgcgcccgtagcccaagccaaggtaggttccgacgagcccgcggtcctcttcgaccaaacggctcatcgtcgtcaggctcatcatcacggcgaccacgaggaacacaatcgggaacgccttgccgagcgactcgatcgagctgatgtcggatttgagcgagctgaacccggcaagcgccgatctcgactgcacgtaccagcgtggcgtggcgatgccgtcgaccttctgctgttcggcggcgaatgcgctgaatgcctcattccgctgtgtgtctatggcctgctgcgcctccctcagtttcgtgtcggcggccgcccattggcgctgcgcctcggcgagttgggccggctccggaacaccgaccggaatctgcgcagtctgggcgtcgagttgcttcaactggtcgtccagctgccggcgctgggcgtcgagtttggcctgcgccgcatcgatctggtcgaacgccttcttcttctcggcatcgagcttgttctgggcctcctccaccaaggcgttgcgccgggcctgctcgcgcttggcctgcacaccgttctcaatgcgtttgaccgttcccgacacaagatcgtcgtaactggccgtgaaggcatcctcattctcggcatcatcgagccggagcacgatcgagccgtacaccttcgggtcggcggcggcgatgggtgtgccatcggccttgacgaaggtgcgctgaatgccgtccggagccgtgtagaacgtgtagtcgttggtcactgacgagcggaatgcggatcccgaatagccacccggattcgtcaggtcggaggggtcggtgacgatgccgacgatcttcagcccatgggtgccatcatcctcaccatcggcggcgacctccaccgtgtcgccgagcttcttgtgggtgtcgtgcgtgaactgcgcggtcaccgccacctcaccgggcttgctcggcagccacccctcgttcacatagggcctgtccaaggcggctggcgagccacttgccggctcttcgagggtggcgttcagctgcttgccgtcgccatccgccaccttcacccgaatcatgcgcatgccctgcgcttgctccactccttccacctgcctcagcgcgtccacgtcggcatcggtgagccccatcgtcgaaattacctgcacatcgtgcaatccctgcgcacggtagaaccggttcgcggccgcgaaagtgtcgcggcagcctgcgtagatgccggtgagcaccgcaacacccagcatcgtgatgatgagaatcgacaggaacggcttccacgcatgcagcccggagcgcatcgtatcgagcaagaatgccgagcccactgcgcgcgcatgcccatgttcggcatgcagcgagccggaatctgcaatctgcgcatgcacatcggcatcgccaacgggaacacctttacgccgtgccatctcgccccccctaccattcaatctgcgagatcggcaccgggtgttcgttggtctcctggctcgtcaccttgccggagcggaaccgaatcaccttgtgcgccatcggggcgagggcggagttgtgcgtcacaatgagcacggtcatgcgctcggtacggcagatgtcctgcagcagttgcagcacctccttgccggtctcgtagtcgagcgcgccggtcggttcgtcgcacagcagcagcttcggtttcttcgccaatgcgcgcgcgatcgacacccgctgctgctcgccgccagacagctgcgccgggaaattgccgagtcgatccgcgagccccactttcgccaaggtctgcgccgggtcgaagtggtctgtgcaaatctgcgaggcgagctccacattctcgagcgccgtcagattaggaatcaggttatagaactggaatacgaagccgatgtcgttgcgccggtacgtcactagatcatggtgattaaggtcggtgatgtcgcggccgcccacgatcacgcgtcccgaggtggcggtatccatgccgccgagaatattcagcgcagtcgtcttgccggcgccggactggccaaggatcacgctgagctcgccttcgtcggcggcgaagctcgcaccgtcgagcgcgcggatggaggaggaaccggcagggtactccttgaccacatcattgaactcgatgtatgccatggccacctccatctatacaaattgcacgtcatcgcacagcatacatatatagattatgcgaaaaccaatctggagtacagtggccgcccccgcgtgctgcccgccaatgcggtgcaacatacggaagcatccgtgggatgtgccactaaccaccccgccaacggcacagctttcggaagcatccgagaaacgtgccacaaaggaatctaaaatggcacagcctacggaagcatccgcacaacggaccgcaaaccacccctgcagcggcacagcatacggacgcatccgagagatgggccagaaaccaccccatcagaggcacatctcacggaagcatccgagaaccaaaccgcaggccgtcttccccgcagcacagcgtacggaagcatccgagaaacgtactgccagaaggctccaaaatggcatgcctctcggaggtatccgagaaacgcgccacggaatggtctgaaaacagcatagctttcggaagcatccgcaaaaccgaccgcgaagaagtctgaaaacggcatgccatacggaagcatccgcaaaaccgaccacacagcggccgacggcaacgcctacttgcgcgtggagtcgagcacggtcttcgcgtcgcgcttcgccgaggcgcgcgaggtgatcgcatacgcggcgaacaacacggcgagccagatcacaccggcgatgagcgcaatgcggtagctcggcgagaagcacatgagcacggccaccatggcgaggaacgcgataatcacatacggcgtccagttccaccccggcagcttgaaccgaatcttcgcgagcgcctcggcaccgcgcaatccgttgagctcgcccggaccatcaccggcagccacacgccgccggaacagcatctcggtgatcatgatcatcgtccaattgataatcgcggcgatcgtggcgatcgacatcaggtaattgaacgcgaactgcggccacaggaacacgaccacgacggccaccacggtcacggcggcgctcgtgagcacgcccgccaccggcacgccgcgcttgttcacgcgtcccagatatgccggcgcattgccttggcgtgcgagcgagaacagcatgcgcgaattcgaatacagtgcggagttgtatacgctcatcactgcggtgaggcatacgaaattgaggattccggcggccaccggcacgcccacggaatcgaagatctgcacgaaggggctcatcttcccgtcgatgcgatcccacggcaccacggccatgatgatgccgagtgcggccacgtaaaacacgagaatgcgccagattatgccgttcgtggcgcgcgggatcgtcttgctcgggttctccacctcgcctgcggtcactccgatgagctcggtgccgccgaagctgaacatgacgacgacgagcgccatgagcaggccgtcccagtggccgtcggccgcgcgcgacatggcgccgtgcgggaagaagccgccgtccacagtgaaccagttcgcgaacgaggcgcgcacgccggagtcggtgggcagattcgctacgatcacccacagtccgcccgcgatcatggcgatgacggccacgatcttgatgagcgcgaaccagaactcgaattcgccgaactcgctcacaccgaacagattgagcagcgtgatgagcacgaggaagaacgccgccgacgcccactgcggaatgttcgggaaccagtagttgacgaaggacccgaccaccgcgagctccaccatcgacacgagcacatagttgaaccagtagttccagcccgagatgaaccccgcgcgcttcgaccagtaccgcgacgcatagtagctgaacgcgccggccttcggctcctccacgctcatctcgctcatcgcgcgcacaatcacgaagatcgccgcgccaccaatcacataggcaagcagaatggacggcccggcgagcgcaatcgactcgctcgacccgtagaacagaccggttccaatggcaccgcccagcgcaatgagctgaatatggcggtttttcaacgatttatgcaattgctgcgggtcggcgttccgctcccctgcaccatgtgaagcactcataggcatccttttgcatagcccgcgtgtgcatacgcggacgctcccatctctcctgcgccgccgcacgcgcgctcgcacgttgctgcggtatcgccattctacgcgcgagccgtatatctatgatcatgccggtgcggtgccgatggatcagattactccccggcggactccggacctctgttcgcacgctccgccgcctgcctgcgtatgcggtcgagtgtgctcaccgagtcacgcgccggcggcacgaaatagcggtcgtacgaaatgaagcagcgcttgtagacgagcgccaggattatcgaatctgcaagcagcgtgagcgcggagaccgccgccagtatgacgaactggtatttggcggcgttcactgggttctgaccggcgatgatctggcctgacatcatgcccgggatcgtcacgatgccacttgaggcgagcatggcgatcgacggaagcaagccgagcgtgatcgacgaggtgatcgacggcttggcggcctcccacggcgtcgcaccaagcgcgagcagcgtgttcacctcttcgtagcgttcgcgcatcgaattgaagaatcggctcaggccgagcgccagcgcggagaccgtgttgccgagcagcatgccggtgagcggtatgatcagctgcggcgaataccacgggttcgggcggatcaccagttcgcccaccaacgcgagcatgagcagcatcgtcacggcaagactcagcagcacgagcggcaccaggcctttcggtatacctttggcgcggctcatcgtgatctgcgcggcggcgacgagcatgaccacaatgaggccgatcaccagccacacattctgcgcgcggatcacatattcgaggatgaagcccatggcgagcagctgcacgagcgagcgggcggtggcccacagcagcgacttggccacgccgagtttcatcagcgcggagactccggcggcgatgcacaccatgagcaccgcgatgagcagaccccagttgtctatggcgaagtattgctgcatgtcagacctccgtgtgcgtgctgggtgcggattgcgcggtctttagcggggagatcgtgccgttcgcgagcaccatgatccggttcgcgcggccgtcgggcttgcggtggcgaatacgcacgaccgcagtgccgttgtctgccgccttgcgcagaatatcggccactttgtcggcgttttcctcgtcgagcccggcgtccacctcgtcggcgagcagcacgccgggatgcgtgagcagtgtgcgagtgagtgaaacgcgtgctgcctggccgccggagagatcttgcacggcgcgcgccagatcgatgtcgtcgcagcccagcgagtcgagcgtggagcggatgagcgagtcgggcagtttctgctcagcggcctcatgatcctgcgagacgcggattttcaacgaccacggtaggcggatcgcgtcggccacattgtcgccgatcagcacggaggtctgcggcaggtaggccacgcgctcgcgccattgctgcggcgagagcgtgtcggaatccacgccgtcgagcacgaatttgccggtcgtgttcacgttaagtcgcgcgaacgaggtgagcagcgtgcttttgccggaacccgacggcccggtgatgtcgacgatctcaccgccgtgcactgcgaatgagaggtccttgaagattgtgcgtgtgccgccggcatcattgttcacgacggcggtcacacccgtcgcatggaaatcgtgcgctgaactcatgcttcccattatgggcagacctcccccgtgttgcctatggcgtaagacacacggcgacctgtgcgagactccgtgaaaccgcgcggccctgcccgactcggactgacatgctctcaactccgcctcacctcaggccgccatgcccccaactctgcgtaaaaaagggtcaatatgcagtgtcgaattgtcccgatttacgcaaatggaatccggcatatctgcgatatctaccctatctgccctatctgccctatctgcgtaaaaagggtcagtatggcggctccatctgactctttttacgcaggaagaacagcacgcgatggctccacgcccgctatatgcgagaagattcctccgccgcttacttagttcgtctcacacgcagatcggattccacggtcttcttcggcagacagctacgcgcaaaagaaaaagcgccgcaaatgcgacgccttgctatttcagccgaccgccatcaccgtgacctaccaagcaaggggaaacacaagtctggtgacggcggcttgctgaaagtcttagttgaggccttcctcgacgcccttcttcgtggcgggcgcaatggacagggccgggtcacgcagcgggatcatcatcgcctgcgtggcgtggtacaggtcggacttgcccggccacacggtgtcgatgacttcgttctcgcggttgagctggtggaaccaggaaccgttcttgtgatccatgaggtaggtgtcgatgtactcgaggaaggtcgcataccagtcggcatactccttcttgccggtcacatggtagagcgtggcggcggtgttcacgccttcggccagcgtccagtgcatgcggtcgtgcacaaccggcttgccatcccagtcggtggtgtacacgatgcccggcgcgccgtcggcgttccaggcgtcttcgaccgcgcggttgaacaggtgctctgccgcgtcgaggtacttcttgccgtcaccgttcagcacgccgtccttgccgtacaccgacagcgcatactgcgtgatgagacgtgcccattcgatgccgtggcccggggtggcgccgtacggcttgaactggtcgtccggcttgtcggcgttgaattcgagctccggctcccagtcggagttgaagtgctccggaatgcgccagttgttctcctcggcccacttgagcacatgctcgatgatgcggccggcgcgcgtacgccagctttcgtcgccggtgacgtcggcgacggccaggcatgcctcgacggagtgcatgttcgcattgagaccgcggtaggtgtcgagttccgcgaagtcggtgtcccaggtgtcgacgctcaggccgatcttgtcgtcccagaacttggtgaggtagacgttctcggcctgttcgagcagttccttggcgcccgggcggcccgcgagcagcgcggaggatgccgcaagcagcacgaaggcgtgcgcgtaggcctgcttggtgggcatatggcagatgtccggcgtgatttcggcataccagccgtcgtgctcctcgtcgtgcagcacgccacgcagaccgcggatgccgtcgtcgacgagttccgcggcgccgtccacaccgagcagcgtggccagcgagtagacgtgcgtcatgcggcaggtgatccaggtggcgcggttgcggtccttccacggggtgccgtcgtcgcccagccagtaggagctgccgtcgaccgccgggaagcgacgaccgaatgcaatgagattgtcgcgggagatgtcgaggaacttcttgttctccggcgttccgatctggtacttcggatctgtgttggccatgtgcccttgccttccaatgaggggcccgcgcgtgacgcaccggcccgatcctgctgttctgccgccgtgccggaatctggatgaggagtcttcgcatgtcttcagattccagatttcccggttcgcgacctgcgatccgctcgcatcgtcgttgacagaaacgttctgtatacagcgtatcactgaagcgcttaagtcgcaagctcgaaatgcctatcgtgtgtcaggtttcacgacctccatatgcggggagggcgaccacgtgagtgtggccgcgctccccgcattccgccgcgcaccggcgaatcagatatcagattgcgcgcatgtcgagctggcgcagcgcatccccggcggtgtcgaacgcaaaatcacgaccccagtattcgatctgcggcatgtcgccgtccggcgtcttcgcgacgatgcacacgccgtcgcgacgcagcacgatatgtggtccctcgtcgtacataggtattgcccctcttgcctgattctccgctcacccactttggtgagggcattgacttttccttgattccataatatattaagcggttaagtcacgcaaacgaacaccggtctgcgtgcgcctcgatcgccgaagatgggcacgtcgcacacaagccgcggaaaatggcggaaacaatctgcagaccataacaaaacgcagatttttcgaacatgaccgcacagtagggaacaccgtccgcgcccagcatttacccagcgcactcactagaatgagatgaggtctaataggcggacgaatggaaggcaagcagccgaagctcacgcccgagcagcgcgaagcaatcgacacgttgtcgtcgacgccgcagtaccaaggggaatcgaagatcaagatcttcatgaagattcccgcgaaagacaaggccgcgtattcccgcacgcacttcctggtgccgctgctcgccgccgtcatcgtgatcgcgctcggcaccttcgtcatcgtgcgcctcgtcagcccggtaccgcgtcccgcactgtatgcggcggcggtgagcggatcgacgccgatgggcgaggccgacaaactcaaggacgactatgcgaagaaactcggcaaagacgtgatcatcgacgactatttcgacatgaacaaagacggtctgtcgaaattgcagacgatgatcggcaatgagcagatcgacgtcgtcatcgcaccgcacgacgtgttcgcgaaactggcgagcttcgggtacttcgacaatctcaagaccacgctgcccgccgcggaatacgcgaaggtgggcaaatacgccatggcgttccatggattcgacgactcgcgcgtgaccgacgcgatcgacgagtcgggcagcgggcagggcaagtccgagccgtacggcctgctgctcgagcatgcgccgcgctgggaccgcatcgaaggcgcggacgacgacgcactcgtcggcatcgccgcgaacacccagcaactcgacaccgccaagaacttcatccaatacctgtacaactaacccatagcaagcatcgtcacgcggcccacgccgccaaaccagccgggactcccgcgtcccgccacatgaagcgtttaaggagaatgatagccggaggaatcttccgtcaagacaacccgtacaacaccgtgatgaaccgcatcggagacatcgccatgctctcggtggcgtggttcgtatgctgtctgccggtcgtgacgatcggtgtgtccaccgcggcggcctgcgaagtggcgcgcgagatgcaggaggaccgcgacaacggcattttcaagggcttctggcgtgcgatcaaacgcagattcggcaccggcatgctgctgacgctgttcctcggcgtgctcattgcgctcggcgccttcgacctgtggtggatctcgcgcagcatggccggcgacatggcgagcgttctctacggcgtcacgctggcggtgttcatcattgtggcgatgctgttcgcgttcctgctgccgctgtccggccgttccaagctgagcgccggcgagcagatcaagcagtccgccaagctcgcgacgatgaagccgttcatcgcgctcgtcgtcgccgcgatctacgcgctgccgatcgtgctgctcgccacattgccgagcgcggtgatgtgggtaccgctcgtctggtgcatctttggcggcggcgcgagcgcctgggcacagatgtggctcatccgccgcgccttcgacctccagccacaggactgacgcacaccgcagactcgctcctcatgcgacacattcccgcatattccctacgggatgtcaccatctgccacaggagcccataaactgttacgggatgtcaccatctgctacgggatgtcatctgcgattaacgggttgttggaatatagccattttctgaggatcgcacccgcacggatgggtttgactatgacatcccgtagcagatggtgacatcccgtaggaaataattaccgggtaatagcagcaacgtgacacaccgatgctggcgaggccaccggaatcactgcgcggcaggcgcggtggaggcgcgctcgatgagctcgtatggcggctcctccacgttctccacgtcctcgccatcgatgagcttgagcatgagctgggcggcgagacgtcccgactcgagaatgttgcggctgagcgcggtgatcggcggatgcgcggcgacgttcatgaatgaatcgccccacgagatgatcgaaagatcctcgggcacgcgcacacccttcaccgaggcgacgctctcccccgccagcgccatcacgtcgttgtcgtagatgatcgcggtcggccgcggttccacgctgagcagtcgcttggtggcctcggcgccagattccggcgtgtagtcggtgtgcaggcagcggtagcgcatgccgagctccgtggtgatctccgagaacgcggcgtcgcggatgtacgagtggccgagctcctccggtcccgccacgcgcgcgatgttcttgtggccgaacaaggcgaggtgccggatcatcgtgcccgatgccgcggcgtcgtcgctcatcaatgtgggcagaccgctcgtcagcgacgaatccgccagcgcgaggcacggcatctgcggattgttcttcatcagctcgatgcgcgggtcgccgatctccagattgagcagcagcagcgcgtcgacgttgccggtggcgatccagtcctcgaggatcgagacctcgtcgtcgtcatccatcgacatgcgcacgagcagcgagtagtcgcgttcctcgagcgcggagccgaggccggagatgaggcgcatgatgtagggttccgcggaaagcagctgtggatcgtagccgagcacgaggccgattctgcgcgtgcgcgactgcgcgagcgactgtgccgcgccgttcggacgccagccgagtttgcgcgccacctgcagcaccttctcgcgcgtggcatcggaaacacccggcttgccattgagcgcatacgagaccgcactgctcgacacacctgaggccttcgccacgtcaaagatcgtcactttggctttctgcgctaccatagctcgcccccattcactgaaatactccagtaatcggtatccagtgtaacttaaagttacttaacaaattatgtcatcgttgacgttgccaggtagccggcatccccgttttcacacagtcttcgcatatatgcgatacgggaatgccgcgcgtaggcagtcgctgcatacgcgcggccgggttgcctgaagaggcgtctgtggggaatctgcgaactgaaattactgaagtttgcagattccccgcggcatgcgactagaagtcgcgcttgaggtcgttcgcgctacgcagcacgttggcggcggcgaaatcggccggatcgcccgcgtagtcggtgccgatgtggaaggtgaccgattcgcccggaagcagcgagacgaggccttcctcaacggtcgccttgtcgtcgaccttgccgaccatgcagaacaggtcacgcacgtagtcgttcgcggtgacggtgagttccacgccgtcggcggtgcgcttggccttggtcgtgaacgcgtcggccggggcatcgagctcctgcgtgaggatttcggccgggttgtagatcacgcgggcgaaggaatcgtcggacggcacggcaacgatgagttcgttgttcgcatcgccgaagtcgacaatctcctcgttcagcgggaagcccttgtggctggcggcgtcgagttccacgtcgtcgatctgctgcgtggcgagcacgttgccgtcgaagtcgacgcggttgaccgcccaggagcccttgtacggctcgttcgtgtcgttgagcacgatgagctcgaggtgatcggcgtcgaccttcacaccctcccagctgtgggtctcgcggtactcctccgaggtgcgcggctggatcgtggccagacgcggtgcgaagaagtcgcgggaggcataccagaccggcttgcggtggccgttgaagtcgacggccgccatgctgaatgcgcatgcggatgcgagagctatggctgcgatcttcttgaccttcatggttcttcctctcattgtgggatgttgtccctggcaatgactctgccttgaatccttgccggaattcgctccccgcagcttcgcgggcttgcgaatcgatgattgaaagaataattcccctcacccgagtttatcaagcgcttaagttcttttaccgagccaatttgcctcagatttcacaccgccgcaaattacctctccgccgcgctttcccgaatttccgcggatttcaaatttattagaccgtcacacaaaactgggtgagattctctgcaagtaatcccaaatagttaatcgcttcaggcgacgcgccgtccacatcctgaaatcaaaacgagccgggcgcgaatatgcaactcgtctgtgcatgctcatacatgtgcatatccacagacattgcatgacccgcgcccggcgcgcccgaacccgctacttggcggagtgctcggcgatgaagttacggtaccagttgtagctgtccttccgtatgcgctcctcggtgtcgtagtccacgtaggtcaggccgaagcggcggtcgtagccgaacgcccactcgaaattatccatcagcgaccacacgaagtatccgatgacattcgccccctcctcgatcgcgcggtggacggcctcgagatggcgacgcaggtagtcgatgcggtcgtcgtcgtgcaccatcttcacaccatccgggccgacttccacctcgtcggggcacgccatgccgttttcagtgacgacgagcggaatgtggtcgtagtcgtcgttcaggcgaaccagcgtgttataaagcgcatccgggtcgatgttccaccccatctgcgtgtgcgggccgtcggtaggcagccagtcgatgtcgctggcgcccggcgcggtggaggcctcggtgctctgcgggaactgcgggcggtcgctcatggcgagcagattcgtcgagtaataattaagccccaggacgtcaatcggctggttgatgagcttgagatcgccgtcatgcacgaagtcccaatcgcagattcccttggtgattgcgaacagctcgtccgggtagtagccgcgcagcatcggatcgaggaacacgcggttggcaatgagatccacgcggtgcacggcatccgcatcaccgcggttcacctgcagattcagcgtcaccgagagatccggcttcgctccggcctcggcacgcactgcctcgcacatcagaccatgtgccagattcaggtgatgggcggcgcggaacgcgagcgggccggcgcccaggccgggggcatgctcggtgccgccgtagctcaggtgcgccgagcaccacggttcgttgagcgtggtgtaggtgtgcacacggtcgccgaggcgcttggccacaatgccggcatactccgccatgcggaacgcggtctcacggttcagccagccatcccggtacggatcttcgttcagatactgcggcagatcccaatggtagagcgtcacaatcgggtcgatgccgtattcgagcagctggtcgacaatgcgctcgtagaaatcgaggcccttctcgttcggcttgccgtccggggtgggaatgacgcgcggcacgccaatcgagaaccggtatgcgttcacgccgagatcgcgcacgagcttgagatcgtcctgccagcggtggtagaaatcgtcggccttgtctccggtgtcgccattcagcacgcggcccggggcgtgcgagaacacatcccagatcgacggcgtgcggccgtcttcgtccaccgcgccttcgatctggtaggcggcagtcgcggtgccgaactggaagcccttcgggaacgtcatcgtcattgctgattcctcctgtcgatacatccgacacaatacacgtcgcatccgagcacagacccgcgcaaatcccggatctgctccggcattcatttacttactctcgagtcagcatatgccaaatatagcatgctcctcccctccacaccgcccgcaacacgcgcatcgccaacaatcttccacatcccccccgctctcttccatccgttacgggccagattccccatctcttacgggctaacttcttgcttacgggccaagtttgtgcgtacgggctacgattttgcgttacaggctaaagaaagtcggggccccggcaaacgggatcattggaacatggcggtttccgactacccgtttttcacgaaaaggcagagatgccctagcccgtaaccgaaaatcctagcccgtacgcacaaacttggcccgtaacagagttcgcaacagagtttcgcagcaaagtgagggccgcgacaccgcgagaataggcatataatcggcacagcagagacacataaggagcagcatgcaattcattgacgcattcaatccggctttccgcacgatgggacgcatcggcgaatcgaagaaccacttgccgctgtgggtgttcccctacacgcaggcgcggttccgcttcaccggcacctccctcgccgtgcgtcttcgcaatttctggaactacggccacacgcgcatcggtgtgatcatcgacaacacccagttcagcgtgcgtgtgccgtcgcccgtcgaacccgagcccgacgccgccgtgagcgtgggggaagacggcatgctcaccattcgcattgcaagccacttgccgaacatcgagcaccgcgcaatcgtattcaagcgcgaagatggcggcatgcactacatggagttcgccggcgtggagattgacgacgacgcgcagattctcgcacctgccgaacccgccagcacacgccgcatcgaggtgtacggcgactcggtgagctgcggcgagcgcaacgaggccgtgctctgcaccggcaaggccgacccggacgaagatctgagcgcctacagcaactcatggttcgcctacgatgccatcgccgcccgcgcattgggtgccgacctgcgcatcatctcacaaggcggcgcaccgctgcttgacggcatcggctggttcaacgcgcccgattacctcggcatggagagcatctgggatcgtgtgcagtacaatcccgcgctcggcgagcccaccgactgggatttccgcgacgacgacccgcaggtggtcattgtggcgctcggccagaatgattcgcacccgtacgatttcatggccgcagattacaccggcgagcaggccgcgaactggcgcgcccgctatgccgagttcctgggcgatctgctcgaacggtacccggatgcgcatatcatctgcacgacgaccgtgctgcagcatgaccgcaactgggaccgcgcgatcgacgaagtggtgagcgagctcgacaatccgcagattacgcacttcgattattcgcgcgcaggaactggcaccccggggcacccccgcattgccgaggacgaagagatggcgcgcgaactggtcgcctacatcgattcgttcggcgcagagctgtggcaatagttcactgagactcaccccttggtggttccctgaaggtcggctgggtagggcatcgtcactggatcgcaagcgccctttacgttcctcaaccctacccagccgaccttcagggaaccaccggtacgacccacccgctctccgacctaaccagcgaatatccagaacgtctgaaacaggtgtcgtcatgccgggcggagggacagggttgaggaacggatcgagtcacgaagccccccctgccccaccatgcattccgcctcgaaccggcgctgctgtgcagggcggccgggcggggttgaggaacgtaaagggcgcttgcgatccagtgacgagaccgcgcccgggcgccctgcacaacagcgccgagagggtggggaccgagaaaccatcgacaacgctttcagacgcataaggagacacaacatgacaactgtgaccggcatcgcaccgggggcatcgggaatggccgaacctaccagcgacaacgacggcgcgcacgaccgcaccagaagcggcaatctgcgtgtggacgccatattcagcgaccacatggtgctgcagcgcggcaagccgatcgccgtattcggcgaggcacccgctggagaagtcgtcgccgcattcctcaccgatgcgcgcggacaggagatcgcgcaatctgaaaaccatgcgaacggcgacggcacgttcatgctcacattgcccgcgctgccggcaggcggaccactcgcattgcgcgtgcgatgcggcgccgacgagctcgtgttccacgacgtgatggtcggcgaagtctggctcgccggcggccaaagcaacatcgagttcgagttgcacaacagcgaattcggcaaggaggccgtcgccgacgcgcacgacccactgctgcgcttctacaacacgccgaagtccgcgcgggtcaatctggccacggaatccgcgtccggttggcagaccgccgaagcgccgcaagtcgcccacatgagcgccatcggctactacttcggcaagcagctgcgcgacgcgctggcgaacggcattgcggtcggcgtcgtggattgctacatcggcggcacgtcgatcagcgcatggatgagcgagcatctgctggagcaaaccgggctcgggcgtaagtatctacaggcatatcgtgacgcgattgccggcaagacggatgaggagatgctcgccgcgcagaccgcctggcagcaggtgttcgacaagtggaacgccgacgtcgccgccgtcaaggaggaacacccggattattcgcagccgcagattgacgcgatgctcggcccgtgcccatggccgccgccagtcacgccgttcgccgagcgcaggccgtacgcgctgtacgaggcgatgatccgccgcgtggcaccgtatacgcttgccggaatcctgtggtaccaaggcgaggaggacgaactcaacgcggctgggtacggcgagctgttgcgcggtctgattgcggaatggcgcacgacatggcatgacgatgcgctgccgttcctcgtggtgcagttgccgcagtggatcgccgcggccaacgccgaacatgatccgctgcgttggccggtactgcgcgacgaacagttcactgttgcacgtgaaacaccgcacacgaacatcgtctgtgccatggactgcggcgaattcgacaacatccaccccgtcgacaagcgcacgctcggcatgcggctcggcgacacggcattgcacgacgtctacggtctgcagattccctgtgccagccccgagctcgtcgatctgcaggtgagcgagggcggcggcgagatggtcgccacgttcaaccatgcgcagggactccattggcacggcacgacgccggattccatgcgcgcgattgcggacattgccgaaagcaccgagcgcaaggccggcgaatccggtttcgagatcgccgcgagtgcggactccgagttcgtcccggcacacgcgcgcatcgagccgagcgacgatctcggcagcgacatgcgcgtcgtgcacctattctcaccggaggtgccgaagccgacccacgcgcgctatgcctggcgcagctggggtccggcaccactgttcaacgacgacggcctgcccgcgttcccgttcgccaagtagcccggtcattgccgcctatgctccggttgtatgccgcggctgccgtggttgccgagatcactgcggtcaccggcgcgcgtctcgggcagccgcagctatgactgcggctcgtttctcggaaacttccgggtaatccaccatgcatgcgggcatacgcggtctatttcacggagtcttccgtacgatatgccgtttgcagaccgctccgcggcacagcttacggaagcatccgcgaaatctgctacgtacagcccgcgccccggcatagcacacggacgcgtccgaaagatatgccgtcactgcgtctatcggcggccaaacacacggaaccatccgaaaaccatgccgtttgcagacacctccgcggcacagcttacggaatcatccgaaagaattaccacttttgccctcatttgcggtcaaacaaacggaagcatccgcgaaaactaccgcgcgcgagttgctttgcggcgcggttcacggaaacttccgcaaactgcgccacggcgggagaacgctcagtgcagaaggccgctcaatgcaggagaacgcaaaaggtggggcatgcctatgcatgccccaccttgacagatgcgaagctcacggcttcatgcgcggacgcaccgcacgcggctcactgaacctgggcgcgggcgatcttgccggtgaaggagttggcttcgtcggcgtccttcgcggcgtcgttgttccaggagaacatggcgcgcagcttcgggccgacctcttcgatgcggacgttggagtactcctcctgcagctgcttgaacttcggggcgccggcagcctggtcgtccatgaactccttggcgaaggagccgtcctgaatgcgctgcaggtggtactgcatgcgctcacgggtatgctcgtcgatgacggtgctgacgtagtcgccgtactgagcggtgtcggagcagctccagcgatccttgttcaggccgccttcgttcatgaggtcgacgatcatcttgagctcgtggcacacctcgaagtaggcgatctccggctggtagccggcgtcggtgagtacctcgaagcccatttcgacgagcttgttcacgccgccgagcagcacgttctgctcgccgaacagatcggtttcggtctcttccttgaacgtggtcttgatggcgccggcgcgcagtgcaccgagggccttcgcgtaagccagtgcgagatcccagccgtcgccgcgcggatcctgctcgactgcggtcacaaccgggacgccacggcctgcgacatactcacggcggacgatgtggcctgggcccttcggggcgaccatgaagaccgggtggtcctcgctcggcttgatgtagccgtagtggatgttgaagccgtgtgcgaaggccagggcggcgcccggcttgatgttcggctcgatgtcgttctcccagattcccttctggtactggtcaggggccaggatcatgatgacgtcggcctcggcagcggcttccggaacgctcttgacttccagaccctgctccttggcgaattccacggacttcgagttcggacgcaggccgacgacgacgtcgacaccggagtcacgcaggttgagcgcatgcgcgtggccctgcgagccgtaaccgatgattgcgaccttcttgccgtcgagaaccgaaagatcgccgtcgtcttcgtaccagatctgtgctgccatgtggcacactccttttatttgtgttcggcgtgggcctcctagcccatgcccatgcttgatgttgtctgccgccgcgccggtcgcgccgtgttggcccgctcgggcggtggcgtctgtaatccctatgtgttggagattttgtccccaaaactgaaatctcatcttaccgaaatctccacgcacgcccgcatcgcgtccatcttttggataccggcggtgccgcgttttggaacgccctccgtttcttttggaaaataccgggcattcgtccatagatcattgattaccgcggagatagattgaccatattctggacattttgtattacgtattgcctatccctatcggactgtttcctattgccctgccgaactcctttcctctcacacggattccaaggattcatatgttcactgcatgtaatccacgttcttggtctcacggcacgtcaagatcgccaccaggcagcacagcgccatgacgcccagatagagccccaccgagccgacaccccagtgcgacgacagccatgtggcgaccgacgggacgaacgccgcgccaacgattgcggcgatgttgtagccgatgccggagcccgtgtagcgcacgttcacactgaatagctcgggcagcaatgcgccaatcggaccgaaggcgatgcccatcagcgcaaagccgaggcacaggaacagcattgcggcggcggtgttgtgcacgccgaccacggcgcggttcatgagcagcgggaacaatgcggcgaacgcgagcagcgcgaccgacgagccgatgatcacgcgacggcggccaatgcggtctgcaaacacgcaggagagcacgatgaacagggcgaacacgcagacggagaccatgagcatcgtcatgtactccttggtggagaagccgagtccaccgccgccctgcgcatcgctcttcgtggcccatgcgagcgaccatgtggcgagcgtgtagaacagcgtgtaggtgacggcgacgaggaacgtggcctgcaatacctgccgccagctggtgcggaacacctcgagcgcaggtgccttgacgacgcgctggtcttgcttcgcggcgcggaatgccggggtctcctccatgtgcacacgcacgagcagtcctacgaccaccaacagcgacgagagcaggaacggcacgcgccagccccatgcgagcatcgcggcgtcatcgttgaacagctcgagcagcacataggtgccgttgcacaggaagaacccgatcggcgcgccaagctcggggaacgagccatacagcgcgcgcttgttcgcaggcgcgttctcggtggccacgagcgcggcgcccgaccattcgccgccgagtccgatgccctgcacgaaccggcagacacacaatgcgagcacggcccacacgccccacatgtcgtagccgggcaggcagccgatgaggaaggtcgcgacgcccatggtcatcagtgagacgacgagggtcgccttgcggccgatcgagtcgccgaaatgaccgaagatgagcgagcccaccgggcgggccaggaacgcgacggcgaaagtgacgagcgagagcagcagcgcgacggtcgggttcgtcgcatcggagaagaacacgcgcgggaagtagttcgccgccgcggtgccataggcgtagaagtcgtagaactcgatcgtcgtgcccaccatcgaggcggcgatgatcgtgcccaccgacgactttcccgcccgtctgagcgcatgcgcgcgctcccccgccagcgccggggcgcggcgccccgcttccgtttccgtttcgaccgcggtcatgaatctccttctttctgtgttgcgatatgcaaaaccctgctcttcggcagggttcgagatgtcatgtgcgtcgccctgccacatcggcagggctggattctgggtatacgaatcagctcgccgatggcgagataataattcgtacaatctgcagtcgtgcgaccatggtctcactcatcgcgagcctcctttccgcgtatccgtttgcgttgctgtgcgcggcgcgcgcttgccgcggcgccgtgttgggttagaacctactccctggcctgcgaccgagcgcacgaggtgtccatatagtgagattttcgaatctggtcagcgagatataatgcggcacttttgctttcaatgcatagacataacaagccatatcgcccagtggcatcatgggtgcgcacagctagggcgacgcacgccatctccatacactacactcgttccatgcccgatgaatcccaccgcacacctatgacctcacctacatcacaggctcccgtgccatcggcaccagctcgcaccacctcacgcttccgcaaaccttcggtcgcgctgtcatggattcgcggcatcgtcttcttcctcgacatccctcccgtgctgtttcggggatggtgcgccttcgttggcagcgaaaacaacgctcctgacaatcctcctgattgcgcgccaatcagtccatgtccggccacgccgattcagcggcatcgcgaaatcacaatagccagctgctcactgggattgtggatcctatgcgtcgttctcccgttcccggcgcttgccgcctgcctcgagcgcgataagaccccgctcgcccgcgcctgcactatcgccccttgcgtcgccgtatttctcgcaatctggtttgccctcccccatctgctcaccttctggaccgaagattacgagccctctgcctactacattcgcttcgccctcatctcgacgttctggcccgcctacatcatcacgcaggcccgctgctgagattttgaaatgtacggcgtaatgccgtacaatattgtcatggcaaccatgacacgaaccgcccgcatcgacatgcgactcaccgaagaggaaaaacgactcattgaacaggccagcgctgcgacgggatctcgcctcaccacctggtgcatcaacaacctcatcaacgacgccaaacgcgacctgcacgccaacgccatcattcgcctatcagatgaggccttcgacaggttcgtcgagaatctggacaggccattgaccgagaaacagcagcagttcctcgcatatcagccggaatgggcatgaccgcgatgccattcactcgcccggaacgcgcccagtgccctgtcgacttcaccggattcgactgcggggaacagcagatcaacgactggctgaagcaccatgccaacgcctccaacaaaaatggaagcgccgcattgtatctgtcttacgatcatgagacgaacgagctcgccggcgtgtacacgctcagctccacaacggtcgcacgcgacgaaacgtatgcgccgtggatgcgcaggaattccccaattctggtaccggcggcgctcctcgggcaacttgcggttgccaaccacttccaacaccggggattggccaaggcgcttatccgcgacgcggtcgacaggacgcttcagctcagtctgacgattggcatacgtgcgctggtggtggatccgctgaacagcaatctgacaatgttctacgattcattggggttcgaaggattcaacggcgaaacgcgaatgtatttccgcatgccgaattacccacgaacgctctgagcgcgcgccggagaccccgtcagtcggcgagacgcgaggaggtgcagagcacaacgacgagcagcgccaacgccagcacgccggcgacaatgaacagcggggcaaatgcgtctgcggcaaccaccacaatcgcgccgacgacgacgccgagcagtctgcccacactgtcgaggctgtgcagcacggcgagcacatggccggtgtgctgcagatcttcgatcgcatgaagcgcctgggtttgcgcgagcgaatcgagcatggccagcgcgcagccgccgaatgcggcgaacaatatgagtccggcgcgattgggcatcgcgatgccgcagatcgacgcgagaagcatgacggtcgacgcgagggcgagcggtgccctggcactggagaatcggctggtgatcgggtcgagcagcacggaggatatcgcggcgagcacataggccaccacggccatggcggcaatcgtcaccgccgtgtactgcagtgaattcggggcatgcaccccatgctcatagcgcaccaggaaccccacgtacgtgatcgagacggcgagcgtggccgagacgagcaggcggatcacggcgatcacgccccagtgcctcacgccctgcggcgcgcggaaggccacgagcagcttgtcttcgtcgagcggagtgacgtgcaggtattcgctcgaatgctcgcgcggcggcacgaacagcacgacgacgccggcggcgagtatggcaccggcgcatatgtccatcgcggcctcgacatggtctgccatgccagcggcgaatgcagcgccggcgagcgaccccgcgaacatggcgacattgcgccacgtggccaccgcgttacggaacttgtcgggcaccatctcgcccaccattgcggagcacgccatcgccatcaccgcatagccgagctgcatgaacacccagacgagaatcatcgcgacgttcgtatggcatgcggacagcgcgaatgcaaacagtgtggcgaccacggtgccgccgatgagccagggtgtgcgacgccccagagaagctcgcgtgcggtccgacatcgcggaggcgaatgccgtcatgaacatcgcgaccacaatgcccacgccaatcagcaccgccagattcacggtgccgtcgaaagcgccgccgaattcgtcgagtcgcagcggcacaagcaccacggtgagcgcgaccatggcgaacgacagcagcagcgacgccgcggcaaagccgcttttcatgcgcaacacctgcgtgtgcgtcgggcggtagccggtggaatcgaccatcggatcacgcaggtcgaagaacgcggattccacgtcgggaatcggctcgtcggaggccgggtgagacagtccggccgcatcggcgagcgcggcggcctgcacctccgggtgtgtggcggcgggcggtgcggtgaccggcttctgccgcacggccaagcgcgcgaccgccgacttgtcttcggcactcagcgccttgtcgagatcgggccggtcgtcaatgccggggcgaatatagttcgatttcgggaacgtacgcggggtctgcggttccgattgctgcgactgcggcactgcggaatcattgctgttcttgctctcattactcatatttcccacagtaaccgctcgccgccgcgccatgcccggcgttcgatgaacgccgagtgaattcgccgttctctattctgccacccaggcgctggttcggattacctaatgcctggcgaaggcgctcagctgggcgaccgtgccgaaatagcgcgccgggtcgagcccgtccaccgtgggcacgttcgtcatatgcacgccatcgaggccgcccgccgcgacgattgcgtcgagcacggcgcggtgccaatcgggttccaggtacggctcgacctgcgggcatcccagcgcgcgcatggcgcagacgagcgcatgcgcaccccagttcgacgtgccggcgacgacgagctggtctgccgccaccgtgcatgcgatgctctcgccgtgcgcgaccacgccgctgatcgcataatcggccacgcgtcccatgccgatctcgttgccgccgtcacccacgcctatcgtatgcaattcaagcaaagcgagctggctgagcggggccgtccattcggcgatgtcgacgccgcgcatgttccgcggtctgccgtcgcgcgccggcccgacgcgttcgatgaacacgagcgtgtctataccgtggcgtttcaccagatcgatgaccatgttgaaccatgcgtcgaattcgggtttcgcatgcggcgcgatgagcacgcggtcctcggggagcagatcgcccgccgccgcgcagatgaccggcgcacaatgttcgtcgctgatgagccacgcgtcgccgcccaccgcgcgtagtgccatgcacacttcgagtgcgcccagcggtccgtccgtttcggcggccggctgctgcgcctgcggaatgtagaatccggtgacgacgagcgcgcgtgcgggtcgcttagttttgcgccggttctcgcgtcgagcacgccgcggctgctccgtgccgagggcaagatggcgtgccgagcgaaacaggtcgccgcgcacataggtcatcagtgtttccgacccgcgtcccacgtcggcggccgccgcggtggcgatgcgtgagatgcgtgggtatttactccagtccgtgatgctgcccatattctcctcgatgaatgttcggttgccgattgccgtgtgcagatgcgcccgctagtcgattgtgccgagcacggcgccgtagtccgcctgctcgccgaccggcacggtgatatgaagcgttccggtgccggcgcaagcgcttcgcgttccatcttcatcgcctcgagcacgacgatcgggtcgccttcgcgcaccggggcgccgtcgtcggcgagccaacgcaccacggtgccgccgagttccgccgtgaccggcgtgccgtccgccgcggtgttggcgtccgatgtgggcgcgggacgggagaggccgccgagccgtgcggcgagcaggcctgaatccacccccggattacccggcccgccggcgttcgcccatcgcccgctcgccggcgcgacgccagtcctcaagcgtttccgagggcagattcggcagcagttcctcctcgatccagcgcgtgtacacgcggaaattcgcattggacacatcgtcgtcggccctccagtctgcacccgcgccgaaatccgctgattcgagcaccgccttgtcgaagggcaccacagtgggcacgccgtgaatgtgcagttcggcgagcgcgcgttcggctctgcgcaggcattcggcgcgcgtggaggccttgacgatgagctcggcgatcatcgaatcgtaacggcttgagatggagtcgccggccgcgacgcccgaatcgaagcggatgccggggccggtgggcacctgcaggctttcgacgacgccggggaacggcacgaagccgagtgaggggtcttcggcgttgatgcggaattccatcgcatgccccccccgcggctctggtgtgacgccggattcaagcccgggcaccgcctccaccggcgcgccctcggcaatggcgagttgggcggccacgagatcgacgccggtgaccgcctcggtgacggggtgttccacctggatgtgcgtattgacctccatgaagctcatcgtgccgtcgtcgacgaggaaccccaccgttcccgcgctttcgtagtgcgcgcgtgagcagatcgccaccgcggcgcgctcgagctcccgcacggtctcggcagccaggaacggtgcgggcgcctcctcgatgagcttctggttgcgccgctgcagcgagcaatcgcgcgtgcccacggcgagcacggtgccgaactggtcgccgagcacctgcacctccacatgccatagccgtgcgaggaagcgctcgacgaagcaatcgccgttgccgaacgccacctcggcctcatgcattgccgattcgaaggcggccgccacctcgtcgggctcgtgcaccaccttcaggccacggcccccaccgccgtagaccgccttgatcgcgatgggcaagccgtgttcgcgtgcgaactcgaccacttcggcggcgatccggcgcgccgcgactttcgagccgagcacgcggatcgtctccggcttcggccccacccacaccattcccgcgtcgatcacggcctgagcgaagtcggcgttctcggcgaggaatccgtgccccggatgcacggcgtcggcgtgtgcgcgcacggcggcgctcgccatcgcgtcgatgttcaggtaggtgtcggcggtctcggccgcacccagtgcgtacgcttcgtcggccagacgcacgaacagcgcgtcggcatccggctccgcgtagccgactatcgcagtgcgtccggcttcgtggacttgatgttcgtgaccatcgacgagaagctcgtctcggtcgggtcgaaggtctccttctcgccatacaccacgttgacgccggcatcgccgacggtcttggccaccacgtcacgcagcgacgtgccatactcgtcgttgaacaccgcgatggcgaggttcttcacgccatcctgcacgatgatctgcccgagcaccacgccctgtaccgtgtccggcggaatcgtgcggaagaagtagtcgttgagacccgagaacgcggtggatgtggcgcccgacgagatcatcggcacctgcgacgacgtcacctgcttgaacgtgttcttcaccaccgagctcgacggcggcccgaccacgaccgacggctccctggcgagcaccgactgcgccgacgacgtgttctggtccgcgtggtcggcgtccgaggtgtcggccgagacgatatcgatgtccttgccgagcacgccgccggccgcgttgatgtcgttctgtgcgagcttcatcgtcgcgatgttcgccggtcccaaatatgccatggagccggtgagcgggaggagcccggccgccgtgaacgtggcctcgtcggcgtccgccttgctttccgcgcccgagccgcagcccgacagcgtgagcatcgccgccgcggccattgccgtcgccgtgaccatccatgacttgattttcgcattgttcattgcaatcaccgtttcctctctctgatctcttgcccgcgcgaatctgcgaatgcaactcttcgcaagcaggcgaagcggtggtttcgattcacatccctagacttcttgcgtgaatctgtctgcagattacgtgcgccacaaaccgagcgcgtgagcgccgcgttacgctcgcatgaacgcggaaaagcgttcgaaacacaaggtgatatggaacaggccggcaacgcgaacgctgccggcctgcggtctggagagaggtaagggattacttgacgttgcggatgcgcatgatgagtgcggccgcggcgagcacaatcacgatcgcgacgccgaacacccatgcgtaggcgacggcgggcgtggtggagacgtgcatcgagctcttgacgatggagacgacgagcgaggtcattgccgtgccgatcactgtggaaagcgtgttggcgaggttgagaatacccagatccttgccggcttccttcggattcggcagcacggccacgttgagcgcctggtcgatcgcgttgtagacgccgtaaccgaggccggcgacggcggcgaacagatacatgcccatcggcgagcggaagaacagcggcatcgcggcaccgacggcgaacaggcagcttgcgagcgccaccggcagcttgcgcctgccgagacggtcggtgatcgggcctgccgtgacggcggcgatcagcgagacgacgagcgtgatcacgcccatggtggcgatgatcgtagccgccttgtccttcgcattcggatcgccggcgtagatgtagtcctgcgcaatgtacagctggtaggtcgtgatcatccagtagccgcccatcatgagcgtgcggccgacgagcgcgtagtagaagtcgggggcgtggcgcggcggccggaagttcaggagcacggacttcacggtcacatgctcgctctgctcctcgaagcggctcgacttctcacgcggccacatggcgacgacgaagatgccggtgagactgaagatgcccagacccatcatccatgcggagaagagtcccgactgcccctgacgcaggaacgcggcacccacgaccgagccgagcgtctggccgacggcgatgccggcgccgtagaagccggagatcgtaccgcgcaccttgtcgggcacacggtcggacatcacggccacgtatggcgcgagcatcatgttgtagcccatctgggcgacgcaccacaggaagatgatcaacgcctcgttgcgcgtgaatgcgatggccccgatggcaagaccggtgatgatgccgccgcccacgatccacggcgtgcgcttgccgaagcgggagcgcgtcatgtcagacagcgtgccgaagatgatgttcgccagcaatgccacaatcgcgccgatcgagttgaccaagccgagcatggcttccttgctcgagttgtcaatcagctcgaacacacgcggcagaatgacggtgctcagcgccacccacggaatcgcgcaggcgactgcggaaacggtgaagccgatgcccaagcgcacgagttcggccttggtcgggcggtggccgtcggccgagaccatcggatcgcgcatgtccatgaatgcggacgcctcgtccggcaccgccgtgtccaccgcggccagcgccgccatgccggagccgacggcctgcgaatcggtggcgagtttggtgccctgcacctgctcgtcgcccacactgctgtcggcggctcgcttcttcggcatcggcgcggtgagacgggagatgttctccttgtcttcctggctcaataccttgtcgaagtcggggcggtcgtcgatgcccgggcgaatgtagccgttcgagcccgtcgacggcgcgctccctccgtgggtgtcttgttcgtcaaccatgatttctcttttccgggaatctgaaaatatctggaatctctatcgggaaccgcgcatcagctcgcctgcatgacgggcgggttcgcaatgaggtcgtcggtgcggtgctcgccagtggaatccgtccagacgagcgtggcgacggactgtgggttctcgacacccatgcccttggacggcgtgaacgtgagcgtagcggaggatccgaaaccgttccaggagaacgcaatcgactcgtcatcgcccaccgagtagctgaagtcgccgtcgaacgccggcagctcgttgcggaatctggcgagcgcgttcagggccttgaccaccggacgttcgaggttcttgtcgatctcggaggtcgtgtaatagtggcggttgatgtcgcggcccacattcgtgcgcttgagcagctccatgtcgttctcgccggcgagcgcgcccacatagtacacctgcggaacgcccggcaggaagaactgcacggcgcgtgcggcaatgtaatgctggtcattgcagccgagcgccgaataatatgtggagttcacctggtagaggtcgaggttcgaagcggcggcgccggttgcggccttcgactcgccatgggtgttcttcgcgatcgtctcgaccatgttgtcgacgtccgcgtcgggcaccagacccttgagcgaacggtcgagctggtcggagccgatgtcgatgacgccgatgccgtcgtgcgtgtcgagcacggtgaccgcattgttcgggcgaatctcggtccagtgcgcgagcgcgtccaccttgccggtgaacagcgagtgcagcagcaatggcggcagcgcgaagtcatagacgcgatccaccttggcggcgatctccacctgcttcttgtagtacgagtgcacctcgatgagaatctccagaccgcgcttggcaccctcctcgcgcagtcgcgagatgagttcgaaggtcttgggggtcatgaagcagctggtgccggcctccttggcgccgtagccgacggcgtcgaggcgaatgtacttgacgtgcgacttgctcatctggtcgaagatcgacatcaggtattcccagcccttggcggagtcggtgtcaatgtcgacctgctgcggcgtgaacgtgacccacaccaagcgggtcttgccggcgaagctgtagtgggtgaacggcaggcccgggcgcgggcggtagatgccggcgagctcctcctcggtcgcgccgtcggggaacacggagctcatcgtgaggaacatcgggtagtactcggaatcctcgccgttcgcgagcacatcctggaactgcttggactgccagctcatgtggttgacgatggcatcgaccatgatgtcatgcgtcttggcgagctcggcgatgtcatcccagtcaccgaggcgggcgtcgaccttggtgtggtcgatcgggtcgaagcctgcgtccgcgccatcgaacggggtgaagaacggcagaatgtgcacgccctcgtacacgccgtcgaatcgcgtgcgcagaatgtcggtcatcgaagcaaggttgccgtcacccaagcgatccgcataggtgatcagctgaactttgttcttcatggctcctcctggattcgtctatcacgtcttcgggatatctccggggcgatgcgtctgcctgaagcttcatcgttgcgcgagctgccgtatcgaaccggttcgagtattgttttacctcattcttcacgcgcatgcaagcgctctgctctcggcgtatcaaaccggttcgatattcgacgattcaccgcgctctgccgaaacgcggttgccggaggacgaaatctgcacatacaatcggatagtgctcgtcaaaccggttcgataccgcgggcgatagcgcacggagcagaaaatgaggaggcgaacatggtcggcatgcgcgatgtcgcgaaacgggcgggcgtctcggtgagcagtgtctcgctggtgatcaacggcaccggctatgtctcacgcgatatgcgcgagaaggtcgagcaggccatgcgcgagctcgactatgtgcccaacgagctcgcgcgcaatttctaccacggcaagactgacatcatcggcgtcatcgtgcccaccatccagcacccgttcttcgccacgctcaccgcgcacctgcagcacgagttcgcggaccgcggtctgcagacgatgctgtgctccaccgccgactccgcgaacggcgaggcgcagtacgtcgacatgctgcgtcggcacagtctggacgcgctggtcgtcgccgcgcacaccacccacgacccgcagtattggcgcgcgatcgaccgcccggtggtcgccttcgaccgcaatctgggggcggggatcactcaggtgagttcagaccacgtgcacggcggcgagctcatcgcagaactcctcgtgcgcaccggcgcgcaccatgtggtcatggtgggcggcccgcgcgcgcaattcaccgacctcggcgaccactccaccttccccaccgtccgctatgtacagacgttggaagaccgcctttcccaagcgcggattgcgcacacgtacatcgagtcgggcgaggtgttcgacatcgccggcgtgcggcgtgcggttcgcgaggcattcgacacatacccggacatggatgcgttcgtgggggccgatctcgccgccgcattcgccgtgcaggaggcggtctcgcgctcgatcgcggtgcccggtgatgtgcagatcatcgcctacgacggcacactcgccgcggattgcgccggcatgccgctcaccacggtcgcccaggatttcaggcagatcgcgcacaccatcgccgcgtgcgtggaacacgggatcgagtcttcgccgcaacgcccggatgccacggacggcgatgccaacatgacgatcatcccggtgacgctgcacgagcgcgccaccacccgtcgctgaggtcggcgcccgacccgcaaaaacagcgaagggccgccttgtgggcagcccttcgtatagaggagagggatggtaagtcactcggtcggcacgtcgccgctctgcatgtcctggaagacgttgacgttgttgccgtcgtactcgaagatgccgatgttcgccgagctcgggtcgttgttcttgttgaagggcccgatgccggtcttgccgaagtactggatcttcttcttgtctttgatgagcgccttgcaggcctcgaagctctcgcacttctcgccgccgtcggcgccggagaccgaggagaggttcttcgcgaccgtctcgccgctggtgctgccgccctgttcggcggcgagcgcggcgaggatcactgcgtcgtaggtttcggcggcgtatgtggtgtcggagatgtcggtgccggtgcccttgaggtcggacttgaacttgtcgtcgacatgggtgccggggatggtgcccttcgagcccttgagcaggccggcgtcgtaggtcttcgagtagtcgacggtgttgccgtcgactagatagagcttgtgcgtgtccacgccggcggaggccagcgccttgatcagcggcgtcgcctgatcgtacgagatgatcagcgtcgcgtcggcgccggagttcttgatcgccgtcgcgatcgacgagtagttcgtctcggctgggtcgaaggcgtccttctcgccgtacaccacgtcgacgccggcatccttgagcttctgcagaatgatgtcgcgcatgccggtgccgtactcgtcgttgaagcaggcgatggcgagcttcttcacgccgtcctgcgcgatgaggtcgcccatcaccgcgccctgcacggcatccggggcgacggtgcggaagaagtacgggtccatgccggagagcgtcatcgacgtcgatgccattgagatcactgggatcttctcggcgacgatgctcttgtagacgttcttgacgacgcccgatgcggcgggtccgatcacgaccgacgggtgcttcgacagcacggactgcgcggctgacgtgttctggtcggcatgctcgccgtccgacgtatcggcctcgacctcggtgacgtccttgccgagcacgccgcccgccttgttgatgtcgctgatcgcgagcttgatcgccgccacctccggcggtgccaggtaggcgagggtgccggtgagcggcagcagtgcgccgatcaccatgccgtcgccgctcgacgccacgctgttcgacgatccgccggacgcgccgcccgacgagccgcatcccgacagcgcgagcagtgccgccgcggtcattgccgtcaacatcttcatcttgtttgccagtcgcatttcagtcttctctcttctccgccgttcgccggcacatctctcatctcataatatttttcatcttcagttatagtatttagttatatttattagtatatctagtaatattatgctttcatttacagattgtttccattttatttcacttgttctctttctcgacctcctcctccagattgcccagatacagcgagatgaccttcgggtcgttcatcaggtcgcgcccgcggcacgagtacgcgttgcgcccctggtcgagcacgtagccgcggtcgcagatctgcaggcaacgccgcgcgttctgctccacaatgaccacggagacgccggccttgttcacctggcgcacgcgaatgaaggtctcgtcctgcatcatcggcgacaggcccgcgctcggctcgtcgagcagcagcacactcggctgcatcatcagcgcgcgccccatcgccaccatctgccgctcgccgccggagagctggcccgccagctggttcctgcggtcgccgagcttggggaagatcgagcagacgtagtcgaagcgttcgttgaacagcttcggcgcctggtatgcgcccatatgcatattctcggcgatcgtgaggctcgggaacacgttctccgtctgcggcacgaagccgacgccccgcgagacgagtttgtcggcacgcagattcgtgatgtcctgccctttgagcgtgagcttgccggagtggatgtgcacgaggccgaacagcgacttgagcagcgtggacttgccggcgccgttcgggccgatgatgcccacgatctcgccgtcgtgcagtgtgagcgaggcgccgttcaagatgttgacgcccggcaggtagccggcgaccagattgtcggcgtcgagcagcggctcgcccgcatggatatgcgagcggtcgagcgtcgagacgtcgggggcctcggttggggtcagtgttgcggtgtcaggcattgccaccctccaatccttcgagtacggagtcgtcgccgaggtcgatgttggcgtgggcgcccaagtaggcgtcgaccacggccgggtcgtccatcaccgtcttgggctggccttcggccacgatcttgccttcggccatcacggtgacccagtcggcgatatggcgcaccatgttgatgtcgtgttccacgaacagcaccgtggtgccgtcttcgcgcagcgagatgatgtgatcgagcaggctctgcttcaacgccgggttcacgccggccatcggctcgtcgagcatgacgagcttcgggtcgcacatgagcgcacgggccatttcgaggagcttgcgctggccgccggagagcgccccggcgtagtcgtccttcttcttgtagagcaggaagcggtcgagcagggcctcggccttctcgcggttctccttctcctgcttcttccacgcccccgggaacagcgaccggaacatgccctcgccggggtggctctgcgcgcccagcatcatgttgtcgagtacggtgagccggctcatcaccttggtgagctggaaggtgcgcaccatgccgccgcgggccactttctccgggttcacatgggccatgtccttgccgtcgaactgccaggtgccggtgttcggggtgtcgaagccggtcatgaggttgaagaacgtcgtcttgccggcgccgttcgggccgatgagggccgtgatgccatgacgttcgatctcgaaatgccgcacatccacggccgtcatgccaccgaagcgacgggtgacgttgtcagccaccagaatcgggtcgggcttgtgcacgccgggctcgttcttcacgtagcgcaggtcttcggtcaccttgtcgccgtaggcggtggagatgagcttctccccctccggcgccttcgtagcccatttcgcgatgtcgtagaacggttccttcacggtggccgtcgagccggcggccgtggtctcgcttgtcttgtcggttgtgtcagccattgaacgccagctccttcttgttgccgagaatgccttgcgggcggaagatcacgagcagcatgagcgccacgcccacgatcacccagccgagggcctcgatctggttcgaggagaccacggtggtcggaatcgtcacacgcatcgtctccttcacggcggtgagcagcacccacagcacgcaggagccgagcacagggcccatgatcgtcgcagcgccgccgagcagcaggatcgtccaggtgtagaacgtgaccgtgcggccgagcgaatccgggttgagcgaacggggcagaatgaacacgatgccggcgatcgcgccgaacaggccgcccaggatcagggcctgcatcttgtacttggtcaccgacttgcccaacgagcggatcgcgttctcatcttcacgaatgcccttgagcacacggccccacggcgagtggaaccagcgccagcacagcagcagcgcaatcgccaccagcacccaggccacgatgcgcagccaccaggagttcgcgatgttgttgttgtaggtccacagcaggaacttggtggagccgttcggcagcggcgaggcgttttcgaacttctcggtgaagttctgcggcgcgatgccggcagaaccgccggtgagccaggtgagcgacgtggagcggcccacgatgcgaatgatctctgccgccgccagcgtgaccatggcgaggtaatccggcccaagcttgagcgtcgggatgccgagcagaatgccgtagatcgcggcaagcaccaatgccgtgagcaccgaggtgaacaggtcgcaaccgttcatctgcgtgatggcgaagccgtaggcgcccagcagcatgaagccggcctgacccatgttcatgaggcccgacatgccaaagtggatgttcaggccgatggcggcgagcgcatatgcggccgtggtcggggcgaagagctcgcccaggatgttggaaagtatggtcatgaaatccataggtcagcccaccctcttttgcttgccgaaaatgccctgcgggcgaatcagcagaacgagaatcagaattgccagcgcgctggcgtagcgcatgtcgctgggaatgacgagcgtgctcatatcggccacaatgcccacgatcagggcgcccaccagagcgccgttcgcggtgccgaggccaccgagcgtgacggcggcgaacatgagcataagcaacgtgacgccggtgttccaggcgatgccgttgaggtggatgccaatgagcacgccggagagcgcggccaggccgcaggagaggatccacacgatgcgcaccaccgaatccacgttgatgcccgaggccgccgcaagcgccgcgttgtcggacacggctcgggtggcgcggcccagtctcgtgcagtagaggaacacggtgacggagactatggtcaccagtgcaatggccgccgcgatgagcgtcggggcgttcgtgacgatcgggccgagctgaatgccctccggcaccgacttgacaatgcccttgatgtcaccgccgaagaagaactggtagatgtactgcaacgccatcgacaggccgatcgtcacgatcatctgctgcatgacgcccacgcgcttgtgccgcagcggtgcccagacgagctggttctgcacccatccggcgagcgcgccgatcgccaccgcgaagatggccgagagcacgaccggcatatgcagcatctgcgtgcccacataggccatgagaccgccgagcgtcacctgctcgccatgggagaaggagctcaggccggtggtgccgtacacgaggttcatgcccaccgccatcaggccgagcatgaggccgaagatgcaacccgagtagagctgctgccagaagcgcgaccagaagccggagcccttgccgtcatcgccggcctgcgcggtattcgccgcagtctgctccccgcttttggcggagtcggcattgccgctttccgtttccgccgcactgcctgccgcggctttgtcgaagcgcacgacggcacgctgcttggagaacgacttcttggcgatctccaccgtcgcgccgctttcgccgagcttgtacttctcggcgaccgccttgtcgatgctcacggtgtactcgccgtccgcattcacttcgaaggcccaggcaccgtcctccgcagtggtggccgtggcctcctcctcgccgcccaacgtgaccgtcacgtcggggatcggcgtcttgtcttgggtctgcagaatgccgctcacacagccgtgctccgcgttcggcacgcacttgtccaccgcctccgcggccacggcgttcggcacgccgatcatgctggcgagcatcgccagcaacaagcccgcgatgcccgcacacacgatggccagaccctttcggcgccgcccgcgttcggcacggcgttgtggttgtgaaaccatggatgccatatgcaccccctctctcttcgttgcctccaatctagggggagaatggcgagcgcaaatttcactcggttttctgttctgttactctgcaacgcggccgttcacatgtcgcttacaatctgtggtattttacgcgcgtgcgaacggaatcatgcacatggcagttgggtcccgcacaatgactgcagtctggcgctaagcaccatgcacctcgccgggttcgatacgcgaggcgagctgccagtgccagcccatgcgtttgcggaaaccgcgcgggctcttctcgcgcacttgcgctgtggcgcgacctcgagcagccagttcaggaactccgccaacggagccctttcccctatgccgcttcccatatgccgcggaatccgatctgcgcgtgagacaaaccaagtaccgcgcacttaatctgtctcgccagattgcgctcagtgaaacagaccaagtatgaggcacttggttcgtttcacgggtgaatctgagatgagataaaaagtagatggcggagcgaaggcattcctcagacaagacctcacgatcctgacgttccgcgatcaggcacggaacagtattcatgtatcaatgcccgatcgagccgaagaaccaccccagcaccacggcgcagaacggcacgacgagcgtggtgaggaagtagaaagcggccaccgcgagctgacgcgtgcgagtgagcgacaccatctcgttgatcgccgtggagaacgtggagaaaccacccagaaaaccggcgacaaacagcaaataagtggaatagttcactgtttggtagaagtatgccgcggccgcagtgccagcgcagagggcggcgatgatgttgatgatgaacgtggagagcgggtaggccctatgccaccagcgttgaatcgacgtgttgagcatgaaacgggcgacggcgccgagtcccccgcatatgcagacgagcaggaaggttcccatcagcgcgcacctccgtcgcgtttgccggccgtgcgctgcaacggctccaccatgtgcgggtctgccagcaagtcgaggtgctcctcttcgctgatgatcggcagctcgtcggtgctcgggttcgggtcgtcgccggcggagggcgtcatctgcacgccgttcgcagtgggcacgcgcacgccaatggccggctttctcacggtctccatgcgttcgcgcacatgcatgccggtgcgtttgcgggcaagacgcaggcccagccagctgccgaaccaagcgatcgcgaacgccgcgacgaacgtgaacagcgtgtacaggaagaatcccaggtacgagtgggagtggagcgaggtgatgtcttccaccatcatcgccgaaagcgttgagaacccgccgcacatgcccatgccgaagccgccgttggcaagctggcgcgtgcgcttcttcacccacacggcctgcgacatgtaactgacgagcacggcgaatatgaagcacgcgcacaggttcgcgatcagcgtggccgggtggaatgccatgagcagaccgcccttcgacagtggctgcggccacagcagccacagcgaatagcgcaggaccgtgccgagcatgccgccaatgaagatcaccagatacatcatgccgtccgcgagcgggttgaacttggcctgcatgcgtttgcggggcgacagcggaatgctcggaggccggcgtgcggccgcggcgccggtggggtgcggctgcagcatctccttgcggaagtccggcgtcaccggctcgtgcggggcgccggtggccggcgagaacgactgggaatcgtagaggtgaaggtgggcgtcggaatcgcccggttccgcggcagcagaggaagcatcgacgtcgcccggtgacgtcgcatcggcatgcgtcaagtgttctggtcgcgtggtcattgcgcgtatcgcctcgtctctattgccggccactgcaccgtgccaaacaggtgttcagattgcgggagtacggcaggcgtcactgcgacgcgcgcggacccgcatgcccgcgaagggcacggaaacagtgtagccgaaagtcagtcgagaagcgaatggacctcgatgatgtggtcgcgctgcgggccggtgccgatcgcggagatacggcagccggagagctcctcaaggcgcttgacatagtcctggcaggtctgcgggagatcttcgaaagcgtgcacctgcgagatgtcctcgctccagcccggcatcatcccatagatcggcttggcggcggcgaaggccgactggtcggtgggcatgtcgtcgtagcgcaccccgttcacgtcataggcgacgcagaccggaatctcatcgagtccggtgagcacgtcgagcttggtgagcacgatgtcggtgagaccattgacctgcgtggcatagcggttcaccacggcgtcgaaccagccgcagcgacgcgggcgaccggtggtcacaccgtattcgtggccctgcgcacgcagccattcaccgttttcgtcgaacagctcggtggggaacggcccttcgcccactcgggtgacgtaggccttggagacgccgatcacacggtcgatcttcgtgggtccgacgccggtgccggtgcaggcgccgcctgcggtcgggttcgacgaggtgacgaacgggtaggtgccgtggtcgatgtcgagcatcgtggcctgacctccctcgaacagcacggtcttgccgtcgtcgagcgcattgttgagaatgagcgacgtgttcgccacgtacggcttgagcttgacgcccacctcgagcagctcctgcacggtggcctccacgtcgaaggcgcggcggttgtagagcttgacgagcatctggttcttctggtgcaacgcattgctcaccttgtcgcgcaacacgtcttcatggaacaggtcggcgatgcggatgcccacgcggttgatcttgtcggcataggccggaccgatgccacggccggtggtgccgatcttcttcttgccggcgaagcgttcggtcaccttgtcgatcatgcggtggtagggcgcgatcacatgcgcggactcgctcaccagcaggcgcgagcagtcgatgccgcggctctcgagcccctcgatctcctcgagcagcacctccgggtcgaccacgacgccgttgcctatgaccggagtcgccgtcgggctgatgatgccggatggcagcaaatgcagcgcatacgactcgtcgccgaccaccaccgtgtggcctgcgttgttgccgccgttgaaacgcgcgacgtaatcgaccttggtgccgatcaaatcggtagccttgcccttgccttcgtcaccccactgtgcaccgatcaacacgattccaggcattccaacctccgctttgggtctaatgtagccgaagtcaggttagcacgagctcttgaagcggcggtttccgggtcgcctcgtgagatgagactgccgcatcccccgattcccgcagggcggcatgcatggcgacgcctgcgacatgcgcgtaggcgtcgcacaatagccgcaatcgcaaaagcaattgcaaaaacaactaccgaggaagcaggaatctgacccgggtgaggaagcaactgcaagaacgacaagagggaagatgcaatccggcaaccatgagagcgcggatgcaaaagaagcactcctaaaagccacaggatggccggcccctcaacgtgactgcaagaacgacaagggaagccgtctacgatcaccccgcggagaatgcagttgcaagaacggcacacgaatggagcggaaaccatacgcgatgagaacgaaattgcaaaaacagcacgcgaaaggaacggaaaacagccggagcgaggaagcaactgcaagaacaaccaccgcgagtggcggtaccgcacgcacgcgccgcccctgcgaacactacttgagtgcgcggccggccgaaccgagctcctcgcaggcctccaccacgcgcgccgccatggaatcctcggcttcacggccccacgagcgcggatcgtactgctttttgttgcccacctcgccgtcgatcttgagcacgccgtcgtaatcacggaacatgtgaccggccaccgcgcgggtgaacgcatactgggtgtcggtgtctatgttcatcttgatcacgccgtacgagacggcctcggcgatctcctgggcagtggagccggagccgccgtggaacacgagttcgaacggcttgccgtcgggcatgtcggaattgagcacggcattgagttcgcccgacttcgccgcattccacacgccctgctgaatctcgtggagcagttcggggcgcagtttcaccacgccgggcttgtacgcgccgtgcacattgccgaacgtgaaggcggccatgtatttgccgcgctcacccaaaccgagtctgtcagccacggccatgccgtcggcaacgctcgaatacagcttctcgttgatctcggcggagtggccgtcctcctcgccgcccaccgcgccgatctcgatctcgagcacggtgtgggcgagtctggacttctcgagcagcttctcggcgatgtccagattctccttgagcggcaccgtggaaccgtcccacatatgcgactggaacatcggctcgcggccgtgcttcacctcgtcgatctcgatgtcgagcagcggattcacccattcgtcgagatactgcttggcacagtggtcggtgtgcagcgctaccgtgatgttcgggtactgcttggccacctcgtgtgcgaacgcggcgaaggcgagcgagccggtgacacggttgttcacgcgctggcccgagaaatatgcggcgccaccgacggacacctgaatgatgccgtcggattcggcgtcggcgagaccctgcagggcggcgttgagggtctgcgaactggtcacgttgatcgcggggtacgcgtagccgcctgcgcgggcggcgtcgagcatgtgtgcatactgttccggtgttgcgatactcatagttccattatgcgcgcgtgcacgttacgcgacaggcacttcacggtgagctcagatgccgaggccgctggccaaaaccagtgggcgaatagtactctggaagaggttgcaaagcgaggttggcagtggcgagaagattgaagatggatcgcgaggatcacgtggcgggcaaagacgccgagcgcattcctgattatgagaacgaggaggcgggccgcgcggagttcgaacacgaggtcgaggatctctcgttcggcgacaacgtgcatgccccgaagcctaagcaccgccatccggcactgttctcggccgtgaccacgctcatcgtgctgcttgtgctcgcactcggcgccggggcctggtacatgtggcaataccactggcgcacgctcagcattgaggtggacggcactgcgtactccgcgaaggccgacaccacggtggcggcgttcatgcgcgaccaccgcgatttcgaacgcaaaccgggtcgcctgctgtcggtggagggcaaggtgctcgaacctagcggcggcaacacggtgagcgtgaaattcgacggcaaacagatcgagcccgccgactgggaccacacacgtttcgaaaaaaacggcacgcttacggtcacgccgggcaccgacctcaccgaggagcatacggtggagcagcggaaggtgccgttcaagacggacatcaatctgaacggcggaccggtgcagatcgtcacccagcagggcgaggacgggttgcaggagttctgggtgggcaggcagtcgaagaagactgccgccaagaccgtgattcgcaagcaggagccgctcattgtgaagtcgttcgcaccgcgcccggagggcaagaaggtcatcgcgctcacgttcgacgacggtccgagcatctactccgacaagatcctcgacattctcaagcagaacaaggtgaaggcgacgttcttcgagctcggcgagcagtcgctcgaattcccgaaggtggagcagcgcatcgtgagggagggccaccagatcgcctcgcacagcgtctcgcacccgtacttcccgaacatgagcgcgcaggagcagcgtcaggagattgagagcagcctcagcgacatcaagaaggcgtccgatgtgagcactcgcacgttccgcgcaccgtacggcgcgttcggcgtggatgagtggaagaacaacgccacgctgatcgacaggaatgtgctgtgggatgtggacacgttggactggaagcggccgggagagaagcagatcacgaaggaagtggtcgattacgtgcacaacggcgccgtggtgctcatgcattcgggcggcggcgaccgcagccagaccgtcaaggcgctgccggagatcatcaagcagctcaagaagaaaggctactcgttcgtcaccatcgatgagctgtgcaagatggccgggctgcccgaggccgccgagccgagccggtagcgctactgcgcggtccggatctgcgtgatcaccgtgcgcaactgctgcaggaacagttggcagacgcgagacaggtcgcggtccttgcgccagatgacgctcaggcgaatgtcgagcggcgggtcgagcgggcgccagacgagatcgtgttcggggtcgctgaactcggtgagatcgttcacggtgagcatgtagccgacgccgttgcgcaccaggcaggccgcgttgtatgcgagattcacgtgggagacgatgttgagcgtcgtgccttgcgtgagccatccggacagatcgcggcgctggttcgcgcccgtcgacgtgatgagcggcatatcgcggatcagctcgttcgtgatcgtctcgttggcggcgatcgggtcgtcggcgcgcatgccgatgccgagcggattggctccgggcaatgagaggtggtcgaagcgcgtcatgtcgatcggctgcatgatcacggcgaagtcggcgatgccgttgttgaggcgttccacattgttcggaccgttgtcgtcgtggatgtcgaaggtgatgcgcgggtacagcaggcgcgtctgcgcgatggcgagcgccacgatgttcatcagattgctttccgccgccgtgatgtgtatggtgccggcgatctcgtcgtgcatatgcacttcggcgcgcgcacggtcggcgagttcgatgatctgccgtgcacgccggtagaacacgcgcccttctttcgtcagcgagatgctgcgcccgcggttgcctcgctcgaacagcgtcacgccgagctcgttctcaagctccttcatctgccgcgacagcgccggctgactcatgcgcagcacgtcggccgccgcggaaatcccctcttcctgcacgacggcgacgaagtgccgcaaggtgcgaatatccatatgaatatcacctcacagatttacatcgaacatttgcatacaattatatcaaatctttgtatttgtaatatctttttcgcggatttaccgtgttcacatacgcaacagcatacccatgcactcccaatcacgtgcactcccaatcacgccgatgtgcggaccggagcgaatggaacgcgaaaggacaactatggcggagaacatgatgaaagccgcggtgttcgtggaacccgaacacgtcggagtgcgcgaagtggagcgcccgagaatcgagaagcccaccgacgcgattgtgcgcgtgctcaaggcatgcgtatgcggctcggatctgtggtggttccgcggcatctcggagcgcccgcacaacacgctcgtgggccacgaggcgatcggcatcatcgacgaggtgggcgccgacgtgcacgacatgaagcccggcgacttcgtgatcgttcccttcacccactgctgcgggcactgcgaggcctgcgagaagggatacgacggcaactgcttcaacatggagcccggcggcaatgccggctaccaggccgaatacatgcgcgccacctgggcaggcaccgcgctcatcaagattccgggtacgcccgccgactacaccgacgagcagatcgcctcgctgctggcgctctcggacgtcatggcgaccggctatcacgccgcgtggagctcgaggatcgaacccggcgacaccgtggtgatctacggggacggcgccgtgggcctgtgcgcggtgatcggtgcgaagctgcttggcgctggcaggatcatcatgatgagccgtcatgaggatcgtgcggcacttgcccgtgaattcggcgcgaccgacatcgttcccgagcgcggcgacgaggcggtggcccgcatcatggagatgacgaacggcgcgggcgccgaccgcgtgctcgaatgcgtcggttccgagcagagcattgaatccgccgtgcgcagcggacgcccgggtgcctatgtgagccgcgtcggcgtgccacatgacaacagcatcgacgtgaacgcgctgttctggcgcaatgtatcgctgaccggcggcatcgcctcggtggccacgcacgacaagagcacactgctcaaggccgtgctcgacggcgaaatcaacccgggcaaggtgttcaccgcctccttcgacctcgaccatgtgcagcaggcctatgaggcgatggacggacgccgtgccatcaagtcgatgatcgacatcgccgaagcgtaacgaaaggtcggagccccatgaaaccaacacatgtactggtcgtgggcgcctcgggaagcatagggcgccatgccgtggagaaggcgcgtgcggccggctaccgtgtgcgcgcactcgtgcgcgacccgtcacgcatccatttcggctgcggggtcgaagtggtccaaggcgacctgacgagcgtggagtcaatgcggcaggcccttgacggcattgacggcattgtgttcacccacgggtcgaacggagggcccacgctcaccgaaaccgtcgattacggtgccgtgcgcaacgcgttggaggcactcgacgggcgtcctgcgcgcattgcgctgatgacgtcgatcggcgtgacgaacatggacaacgactacaaccgctccaccgaggcccatgattggaagcgccacagcgaacgcctggtgcgcgcctcgggcaacgagtacacgatcgtgcggccgggctggttcgacatggagggcgccgacgagcaccagctgaagttcgagcagggagaccggcgcgaccccatggggccgcaggacggctcggcggcgcgccgccaggtcgcccagacgctcgtcgacgcactcggctgcaaggaagcggaccataagacgctcgaactcatcgacgtggccggcacggcgcaaaccgacgccgaactcgcgtcgatgttcgccgcactgcaacccgacaccggactcgacggcgtgctggaccgcgacaacttccccgagtgcacccagcccaagcgcgtacgcgagcagatcgcacgcatcgagacgatgcgcgccgaacagtgagcggccgcgatccaagcacgttccacagcacacctcacctcattgaaacaaacaggaaggcaacgccatgagcaagcaattggtcgtatacatctccgccaccggcaccacgcggcgggtggcacagaacctcgcgaaggcgattgacgccgatctcgccgagatcgtcccggtgccgccgttcaccgcgcaggacatcgactggaccgatccgacgagccgtgcttcgcgccagcacgccgaccgcgcaatgcggccacccatctccgcaagcccctccgcagacggctacgacgagatcttcgtcggctacccgctgtggtgggacaccgcaccgcgcgaagtgcgcacctggctcgaatcgcatgatttcaccggcaagacgatcaccacgttcgccacgtcgtcgtcaagcacacgcggcgcactcggcgagcaactgcacgattcggcaccggacgcccattgggtgaacgggcgtcgcttcgccgcgaatgccagcgaggccgaactcaagacctgggcggattcgatcgcctgacggcacggtggtggatgggcgtgcatgccgcgcccatccactgccccagcactcactcctccaacccgagcacgttgctcacgtacggcgtggtgccgtcgagcaccgcctcgtagaactgctccttggcatcgatgtaggcaatcgaatcctcgatgtcctgcaaccgatgctggagctcctcacgtttctccgccaatatctcccgccgctgcggaatggacgcctcaccctcgaggcatagggccacgcaccgcttcatctcggcgatgccgaggccgcagcggcgcagacacaccaacgaccgtatccatgcgatgttgtggtcgtcgaagaccctgtggttgcgtgcgtcacgatgcacacgcggcacgagctccgaccggcaatagaacttcagggtctcgtagctcaatccggtgagctcacaggcctgcttcatcgtgtacatggtcgctcccatccgatcgcgtcgtgtgccgtacgcgacagcattcacgatcatcagacagtatgcccgatgctgaccggtaccgctaccggcacatagccgagagaaaaccaattcgcgccggtagcgctcccgcccgctagatttgttggcaccgaagccgccggcatcgacaccgaattccaccactatccacaactcggccacggcttcgggctcggcgtgggaaccaccgccgaaggctggatcgatgacgccacggcgttctgggccaagcacatcgagccgtgaccaattccacagcgcatccaatccacgagaacaaccggaaaggaacaccatgaacaccacgtcaacccgctcacgcggcctactcgcactgctgcttgccttggcaatggtcctcggcttctccgcatgcggctcgacctcgggctcctcatcgaactcgtcgggatcctccacggcgtcgaacgattccgggaacaacaccggcacctccggcgacaccccgaccgtgacgaagggcagcaacggcaaggcgctcatcgcctacttctcgaagacaggcaccacgcagcgcgccgccgaggaaatacagaagctcaccggagccgacatgttccgcatcgaacccgtgcaggcctacccggaggaataccagcgcaccaccgagatcgcccgtgacgagctcaaccagaacgcgcgcacgcaggtcaaaggcaaggtcgatgacatggcccagtacgacacgatcttcgtgggctacccgatctggtggatggaaccgccgatgcccgtgctcacgttcctggaatcctatgacctcaacggcaagacggtgatccccttcgccacgtccgcaagcagcggcatcgacggcacgctcgacatgcttcggtcgagcgccaagggcgccaacgtcaccgagggcctgcgcgtcacgtcgaacgacgagattcagccctggctgcagaagatcggcgtgctcaagtagcctgccgtttccttacgctaaccgacgcatatgcccatgaaacgcattgcaatccgtcgattccccattcaggctgtattggtgtgggccgccgcgctcgtcgtggtgcccatgccgttcacggcgatcccatgggccacgctcggacccatgtaccgttcgatgctcacgcccatcaccgccggcatctacgcctacatatggatgcttgaatgcgtgtggctcggctgccgaccccgctggctcgaccgcatcataggactgcccggcatctacgtgctgcacggcgtgctcggcaccggggcgctcgcgctcgttgtctaccaccaatacgtgctgccgtcgttcggaccggcgaaaacaacgggcgagatcgcgttctggacgttggtcggcattgtcgcgctcgcactcgtcatgatggcaggctggctcgatacgctggttccgccgctcgccaccgtgcgcagctggctcgaacgcgtgttccgccatgagttcaccgtgtggctgcaccgcattgtgctcgtcgccgtcgtgcttgcctgcctgcatttcaatctggtcttctatatcaaggacctcacggcgttcatcgtcacgatggacgtgaccaccgggctcgtgctcgcctggtatgcgtgggtgaaattgcgcgaccgcatgttcgccgcccgcggcaaggtcgtctccgcgcgcagggtctcaaacgacatcgtggagattctcgtggactgcccggcgatgcacagctgggaatacggcgacttcgtgttcctcagactcccccgcgaacgcggcatgcacgggtcccacccgttctcgattgcgaatctgcccggcgagcatggtgatgcgatgcggttcgccgtgcgcatcaacggcgacttcaccgagcggctgtaccgcaccgcgcgggccggcatgcgtgtggacgtcatcgggccgttcggcatgtatgaacggttcatcgcacgccacgatgcgcatgcaccgatcgtcgtatacgcgggcggcgtcggcatcacgccgatcatacccacgatcatggcgctgtccggcaccaatcgcccggtcaccgtgatgtacacggcgaaacgcgccgacgacctgttgtatgcagacgaattgcgtaagtggagcgcaagcgaggcgcacacgccgcacatgcaggtggggcgctggagcaagacggaactcgccgaacagatcaccgatggcgcgatctacctgatcgccggcccctccggcatgatccgcgacgtgcgccgcatgctgctacgtcacggtgtgcccggttcgcgcatgttctacgagccgttcacccggtagaccctgcataaccaattcacttattggacgagtattgagtatcggaggaagccatgcgaatacgccacggccatttgttcacacgactcgccatcgctgcgattgcggcgttgcgtgacgcaggcgtgagcgtcgaaacccatgagatgaacggctggccgcacggtttcggcgccgacggcggctggatcgaccagtatttcgccccatggctcaccaccgtgttcgcccggtaatctgaacccaacccacatctacgaataacgcatacgacactggaaaagaggaacctatgcaatacaccacactcggcccgagcgacctcgaagtctcacgcatctgcctgggatgcatgagcttcggcgatgcaggcaacggtcaacacagctggacgctcgacgaggagtcatcacgcgcgattgtgcagcaggcgctagacgcgggcatcaacttcttagacacggcaatcgtctaccagaacggcacgtccgaggaatacctcggccgcgcgctctcctccatggcggcacgcgacgatgtggtggtggccacgaagttcctgccgcgcaccgacgaggagatcgagaacggcgtgagcggccagcagcacgtccgcgacaatctcgatatgagtctgcgccatctcggtatggaccacgtggacctgtacatctaccacatgtgggattggcgcacgccgatcgaggagatcatggagggcttcgcgaacgccgtggccgccggcaagacgcggtacatcggcgcggcgaacatcgcggcgtggcagctggagaaggccaacgccatcgcccgcgaacatggctggccgcagttcatctccgtacagaaccacatgaatctgctgttccgtgaagacgaacgcgagatgctgccctgcgcgcaggaggagggcatagcgctcaccccatacagctccctcgcaagcgggcgcctgagccgcaggccgggcgagacgagccgcagactgcgcgaggattccttcgcccacggtaagtacgatgccgccgccgcaatggatgccgacatcatagacgaggtgagacgcatcgccgaagcccgtggcgtgacgatgacgacggtctcactcgcatggttgctcaccaaagtgacggcgcccatcatcggcgcgacgaaaccacatcatctcgacggcgctgtcgcggccgtcgatttcgagctcagcgacagcgaaatcgccgcactcgaacgtccataccagccgcatccaatcgtcggtgtcatggcacagaacacgaaggagaacgcagccgtcgccaaaagctgggagcgcaagtagcgacgaacggccgaaccgcccaccagctgcgccgcgcaggctaggcgcggcgcagctggtccaggaaccgctcggctatcgggctgagcggccggttacgccgccagacgaggtgcaatttggtctcgagggccggtttgagcgggcggaacacgatgccggaatccgcgctggtgtcgacgatcctatcgaaagtgagcagcacaccgagcccttcacgcgcgaagacggccgcattgtaagcgagtccgaaggtcgcctcaagccgcagatcgggcatgcgcgagccagcccagcgcgcgatctcatgcttccatccctgttgcgagcagaacagcggctcgcccaccaagtcgtcgagttcgacgtaagaccgcgatgccagccgatggtctgcgggcacaatgatgccccaccgatccacgcccgggaaggtcagcgcctcatacttcgtcagatcggggtcctgcgcgagcacggcgaaatcgagcgagccctgatcgagatgctcaagcacctgcgcagagacgccgctttccacgtgataccgcaaatccggggcctgttcgcgcagaatcttgatctgccgggcgagatattgaatctggtatgactccgcgagcccgaaatacagcgtgccgccggtgatgttgccaagcgaggcgaattcgtcttcgatgcggttcgccatgcccaccagatcgcgcgcacgctcgcgcagcacgcgcccctccttggtgagcgtgaggccgaagctgcgccgcacgaacagtttcgccccgagttcgtgttcgagcgatttgatgagcttcgacagcgacggttgcgacatatgcagattgcccgcggcgcgcgtcatgttctcctcgcgcgcaacttcgaggaatgcacgcagctcgcgaatctccatcggcttcctttcccaatattattcccatacagaataatgattataccaaataactatttgcgttatatcgccattgcgttcatactgacatcatcaaccaaacaccaactgcataccaacaaggagtgaatgcaatgacggcacttgaactgaccccggtatgggacaagaccttccctcagagcgacaaggtggagcacggcaagatcaccttccacaaccgttacggcatcgagctggcggccgacgtatacaagccgaagcgcgtgccggcgaacggcagattcaaggcgatcgccgtctcgggacccttcggcgcagtgaaggagcaggcaagcggcctgtatgcgcagaccttggccgagcgcgggttcctcacgatcgcgttcgacccgtcgttcaccggcgaatccggcggctcgccccgcgcggtcgcctcccccgacatcaacaccgaggatttctccgccgccgtggactatctggcgaaccgcaccgacgtggatccggagggcatcggcattgtgggtatctgcggcttcggcggcctggcactcaacgcggccgcgaacgacccgcgcatcaaggccaccgtggcgagcaccatgtacgacatgagccgcgtcaccgcgaacggctacttcgacgccgacgactcggccgccaaacgcaatgagatgcgcacacagctggccaagcagcgcaccgaggactacgcgaacggcgactatgcgcgcgccggcggcgtcatcgacccgctgcccgacgacgccccgcagttcgtcagggactaccacgcgtactacaagaccccgcgcggctaccatgcgcgctcggtgaactcgaatgccggctggaacgtcacctcgtcgctgccgttcatgaatatgccgctgatgacctacatcggcgaaatcgagaacccggcgctgctcatccacggcgagaaggcgcattcgctgtacttcagcaaggccgcgtatgagaagctcgagcatggcgtgaatccggcgaacaaggaactgctgatcatcccgggggccaatcacaccgacctgtatgacaatctcaatgcgatcccgttcgacacgatcgccgggttcttcacgcggaatctgtaagcgcagaccgcgcagaccatatgcacatcgcgaatgcaatacatgatttttcatcatttgttgcatgcaacagtgcgccgcataacactcacagacatgccgagcgcggcatatgaaaaggcatatgaaaagaggcaagcaatgaacaattacccgattcccgtcggcgttccgaccgcatacgcacagtcgctcatgttcccggtgggcgagccgaacgacgcctacgcgcagtatttcaccggcagaagctggctcgcgccggtctccggcgaacaggtcagcatggccaacgtgaccttcgaacccggctgcatcaaccattggcacatccatcacgccacgaagggcggtggccagatgctcatctgcgtgggcggccgcgggtatgcgcagatcgaaggccaggaaccgatcgcgatgacgccgggcaccgtcgtgcacattccggcgaacacgaagcattggcacggcgcggcccccggcagctggttctcgcacatcgccatcgacgtgccgggcgagggcaagagcaacgattggctcgaaccggtggacgaggcattctaccgctcgctcaagtgaaacaatacgcaaaggagtctggaatggctggcataaccgaacaaccgaatgaacgactgaaagagacagacccgcagttcgccgagcgcatgctgcatttcgccgacgtggaggtcgcgcgagaccccgaaacggagcttgaaccgaccacgcgctatctggccatcctggccacgctgctcggctgccagggcgcggatgagttccgcattcagctcgggcgcgcgctcgacgccgggttgacgccggtgcaggcgaaggaggtcgtgcaccaggccgtcgactacctcggcatcggtcgcgtgcggccattcctcgccatcacgaacgaagtgctcgaagcgcgcggagtggccctgccgttgcccgaccagaccaccacgaccatggagaaccgcctcgaggccggcaatgccaagcaggtcgagctgttcggcgagggcatggacaagagctacgagcgcagcaaggtgaactattggcttgcagacaactgcttcggcgactactacacgcgcaccgggctcaccaatctgcagcgcgagatgatcacgttctgctatctcgcggcacagggtagcgtggaaccgcagctgctcgcccacacgaaggcgaacatcgccctcggcaacaccgccgacttcctgcgcacagtggtactgcagaacctgccctacatcggctacccgcgcacgctgaacgccctgcgcatcgtcgcggaggccgacaaagcgaagcaaggagcggcgttcaacctgcaggcattggcgtgggggcgggctgttgcctgatgaaggtgcacgcatccgtggcgggatcgtacgagaacaccgcctccacgactgtgccattcggcgcataatcggcatcttctccctgacccattgcgagataggccgtgccatcctccacccatacatgcgtcggcgtatcaaacgggtaataccccagcttgccctccaaaccaggttccttgggtattcccagttcacgccatgtggcccctgaatccgacgagacatgcagcgatccggcctgcccgacgatcaccgtggtgtcattgacccatcccgccatcgtcagatcggacggatattgcatatacatcggaatctgccgccacacagcctccgcatccgcgcgcagttcgggcaacgtgcccgcgaccatcgcatacccgaccgagccaagcgtgtcgccatacccatatgccaccccgatgcggtcgccaaccacggagatgtaggagggagcctgcacaccgtgccccaatgccgacgtgagccacgtcgaaccggcgtcccatgaatagaggagttgcgccgtatgcgtgccctcgtcgtaccccacgaacgccgtgaactgtggcgtgatcacatacctcgacggctcgagccatagcgtggtgttcgcgttgatgccgcctacgatgcgcgcgacgccgtcgggcacctcgcgccacgtcgtcccgccgtcgtaggtcacctccagcctctctttggacagacgatacccattgcggccgtcgagcaccggagccgtgggatccggctccgtcttctcgaactgctccggatacgccaatcgctgatacatgatcggctccatcacctgcgcgatgcggtaaccgtcctgacgcggctccgatgtgaacacacacgattcgttgattcccgactccacggcgtatgtctggcatccatgcacgtcggtgatgcgctggatcgacgcaaaccgcgggcgcaccgtcgcgtccagccgcacgtagatgttccgcccatcggattggtcataccgcgacgcgatattcggcaatcgctgcacggtgcgaatccgcaccgagctcaactgatactgcggcgcaacgccgatttcctgccgcctgcccttccactggctgtaccattgcgacacgtcatcggtcaccgaactgtccgcagacacgcgcgcaatcgtctgccccgtcatcgatggcaccctgtaagcgtgccaccatgtggacagacgcactgcgacgccggccaacagaccgattaccaccacgcaggcgatgatgatggcgcgtacacggtggaaaccattaccccgtgccgtttcttgcgactgccgctcccgacccatacacccaacctaccccaccaggcgcatacctccgtccccgacgcaccccatcgcgcagtcgccaccatacagatcagccgtgcgcgtacaaacacacatggccaatatatgcgcgccttgcgtaaacgcgacattacgcgcgacattacgcagaatcggtgagcattcggcgctccctctcaccaacccaaatctgacctcctataatcaaggcaacgtacagccatcgaggaggaggcacagatgcagggatttgcaacatatgcgagtgaatacggaccggtgcgcgtggactggcaggatgatgccgttgttcggctgcgcatcattccgcaggcggactacgacgccgacggcgcaggcgagacgaccgggctcaccgacgagacgttccgtgagctcgaacagtacttcgccggcgagctacggcggttcaccgtgccgattgcgttcgcgagcggcaccccgttccagcaggccgtatggcgcgcattgctgcagattccgtacggcgagacgcgcacctacgcgcagatcgccgaggcggtggggcacccgaaggccgtgcgcgcggtcggctcggcgaacaaccgcaacccgattccgttcatcgtgccatgccaccgcgtggtcggcgcgaacggcaatctcgtcggctatgcctatggcgtggagatgaagcgttcgctattgcagatggagatgcgcaccctcgggcaatgatacgaaattgacatctgccattgtatagacaatgcattacataagttatacaatggcagatatctatttcatcagccagaagaccataggggttcgcatgagcgagacagcgaccgtgagctttcgtaccgacccgaaagtcaaggaagaggccaaggcactctatgaatcgatgggcatggacctttccaccgccctcaacgtcttcctgcgccaatccattcgcgacaacggcatgccgttcaagatcacccgcgaacaaccggagagcattgaggcacgtcggcagacggaagcacacgaaggcaggtccttcaccagttccgagagtctgatgaaagacctgatggatgcttagcaccgtatttcgcaccactcaattggtgctgacacgcaccggctcgcatgacgacctggcctgaatggcaatcgtcactcacatcaaagcgctaccgctgctcgaacagccagcccatgatctgcggatcgcgggcgaacagccgcgcgccccagcgccgtagatttcgcatggtcatatggcatcactccaatcggcagcatggtcatgcatgttcggcatatggtagtccgcactgcggggagtcgctaccggcagtgcgcgcatacagtattcgcacagacaccacgtaacacagcacaaggagattccatgggcattctgttcatcaatggcggcgagatcggcggtaacaccgcgcaccttggccacgcgttcctcgagggccgcgatttcacgcagatcgacctcgccggcaaacgcctcttcttcctgttccggggcggcgcgcccacgcagcagatgtacgagcgcggcgaatacaccatcaaccgcttcgccggcctgtacggtatggattacatgggcatggcccgcaatgcaagcgaggcgcgcgcactcgccgccaagctgtgatcacatgccctcggtttcgcaatctgcccgcagattaccgcacacatgacgaaacctgtgcacacacaacagcagacctcgctcaggcacgcagcggattctcgtcgcgaccgcgccgctcataccgcaccgagtaaagcacgagcagcagcacggcgagcgcggcgaacgggacgccgctcagagcggggtaatggtagttcatatgcgaggcgtccagcacgccgccgcccaccatcgagccgacggcattgccgaagttgaaggcgatctgcacagtggccccgcctatgagctcgccgccgcccttgccggcctccgccatgagcagctgttgcggcgctgaaacgaagaacagcgcgaacgaaatcacaaaagcgaacagcgccgtgctccagcgcgagccgggcacgaggaacacggcgagcaagccgacgcaggcgatacactggccaagcgccgaagtgccgccgggcacccagcggtctgcgatgcggccgccgatcaatccgcccacgaccatgccgaatccggcgagcatcatcagcgcggagatcgtgttgttcggccatccgcccaccttctgcaaccatgggctcacatagctccaccagcagaaaatacctgtgttcccaacgaaaacagcgatgagcaccatccaggggcccggttggcggaggaatctgaattgcccgcgcagaccagcgtcacgcacaggcgccacagatgggatccatgcgcgcgcgagcacggcggtcaccgcggcgcacacggcaagcgccacaaacgccagtcgccacgacatatgctcggcgagcagcgtgccggctggcacaccgagcatgttcgccacggtctgcccggtgaccatggatgccacagcacgcgcctccttgcccttgcgggcgagcagcttggcgaccagcgtggccgtgccgaagaaggcgccatgcggcagaccggcgaggaagcgggcacccacgagcatcggcgcgttcacggccatggcactcaaggcgttgcccgcgcaggcgatgaccatgaacatgacgatcaatgtgcgcggcgggattctgcggccgaacacgagcatcagcgtgcccacgcacacgccgatcgcgtatgccgagatgaagtgccccgccgtcggaatgctcacctgcagggtctgcgcggtttgcggcagtatgcccatcatcacgaattcggcggcgccgagcacgaacgcgccggctgcgagcgcgaacaatcccaagccgttgccgccggttctgccttgttttccgccgcggtcggcccgcgtcgccatgttcgtcgcgcctgtcatacgtgcacctcacctgtgtctgcgcgtaaatccactgacttaacaaaataagattcgcaaccgacaaccacacgggcatatccgtggcggccacatgcccgctcagcgcaccggcttcgattcgagcggaatgtccgaacgatcggcgagcgcgcggtaatccggcccgagccacagatcgagctcaccttgccgcacaatgagcggcatgcgcgggtgaatcggctccatgtcggcgttcgcctgcgtggtgaccattgagaactgcgaaccgcgccgcacgccgccgatcagcatgaccggttcgtcgggcacgcggaacacatactgctgcttgatcttcctgccggtgcgcgcactcaccgccatctcgctgccgtgcgattcatagaaccagcggcaggcgatcacacagcggtcgtgttccatcggcgcacgccacatcggcttgtctgcgctctcgatgcgtgtattgaacacgggctgcggtgtccactgctgctcgaatccccactgcgcccgtgccgtctccagactccccggctccagttccggtacgcccacggctgtgtcgaatttcggcacgatgatcggcaccaccgacttcgggtatgcctcgacgccgactccggcgaattcatcgtcggccccgacccgcgcccgactgcgttggcattgcatcgtgagctcgtcgacgagccgctccagctccgcgtccgtcaatcccagataatgtgcgcacatacctccagagtaatccgcgcgcaccctgcagctgccggtcgaatattgtgaaatattggacggattcgcccgcgttgcacgtcggtgtgcgaatatggattgcagattcccattcctgttcgaacgcgcagtcacgcgcagacaagtgaggcgagacatgcgcttgttcgcagacaggccgtcgcaagcagacggctctcgcgcgcgcatcgcctccgcaatcctcaattgggaacgttcgctcgcccattggaaacgcgtgctcaccgtaatcttttccgcattgctcacagtgattgccgtggtctgcttgggcgtgggactcaacatcgtcggccttgggcgcgatacccaagccatccctccggctcccgtcaccgaggtcgaggcaccgcagctgccggtgccactcaccgacgacgccatcaaggcggccggtctgcatgaggcgacgcccacggtttcggtctcgcagatgaccgcgaccgcgctcgacaatctgagcgcggtggacggcagctcggcactcgacaccgtcgccatctcactcagcagtgatcaacgcgagcagatcgagcagaatctgcaggcgttcgccgacgccggtgcgcaggtctcgttcgccgtcgccgacctcgggtccggcggcgtgatcgcggcgaacggcggcgtggcgcggtacccggcgtcgtcgatcaaggcgccgtacatcgtgtcgctgctgcaggagggcgcagtgaatctggatgagacggcaagcgggagcacgctgtccgcgcagatcaacgcggaccatattgcgggcgtgctgcggtattccgacaacgacgggtacgatgcgctgtggaacgcgcatctgaacagtgcgatcatcccgtggagcgaaggcctggtggagaatccggaacgcatgcgcggattccagtacccggatgtgagcgcggtggaactcgcgaagatgtgggtgaagacgtacggatacctgttcgccgatgccgagggcgaaccgaacgcgggtgagacggcgagcgcaccggcgcgcgaatggctcgcctcgagtatgcatcattcgctcaattcgtcgatcgacgccgcacacggcggcgaagagaatccggacggcacggtggtgctgagcaaggccggctggatcaacggcgaaggagactattacgcgctcaacgacgccggcatcgtgctgccaagcggagagagcggcaacgaaccgggctatgcgatcgccatcatgagcaacgcgtgcggccggaacgatctgctcgccgatctcgccggcacgctccacaatattctgtcctgattcgcgaattcacccgcccaccgctcgcatttgccgtacactaggctctatgactggcaaactgcacttgcacaaccattacaacggcctgaaaactgctgtattgttcgcgatcatgtgggcgatcatcatgatcatctggtgggccaccggtgcgcgcacatccacgctcggcatctacctggccatcggcgtcggcacgtcgttcatctcgtactggttctccgacaagctcgcaatcgcgtcgatgcacgcgcagccggtgaccgagcagcaggcgcccgagctctaccgcatcgtgcgcgaactgtcgcagcgcgcgggcaagcctatgccgcgcatctacatcgcgcccaccgagacgccgaacgccttcgccaccggccgcaacgagaaccacgccgccgtctgctgcacgcagggcattctgcgcattctcgacgaacgtgagattcgcggcgtgctcgggcacgagctcatgcatgtgtacaaccgcgacatccgcacatcggcgatcgccggcgccatggccaccgtgctcacctatctcggctattcgatgatgtacatcggcaattcgtcgagctcgaaccgcgaccgcgacaacggcgccggactgctcggactcatcggcatcctgctgtccaccgtgctcgcgccgattgccgcctcgctcatccagatggcgatctcgcgcacccgcgaatacgacgccgacgaagacggcagcgagctcaccggcgacccgctcgcgctcgcctccgccctgcgcaagatctccggtggcgtggatgccaatccgctgccgaagacgagcaccgacacctccaccgccgcgatgatgatcgagtcgccgttccgtggtgccgacgtttccagattgttctccacgcacccgccgaccgaggaccgcatcgcgcgcctgaaccagatggccgtcgacatggggcagatcgctcccggtgccgcttcgccgcaggttgcgggctacgctcagtattcgcagtaccgccagcactgagcctgcatggttgtggacacccctgcggacgcggcgcgcgcttatgccgcatctatggtagactgtcgaaagtgcgtcgccgcgggcacgcattgcggatgtagttcatcggtagaacgaaagcttcccaagctttaaaggcgggttcgactcccgtcatccgctccactgaaaacggctgatttccaacgaaatcagccgtttcccatatcgcttgcgatatacactcacccgcgcgagccgttcgcgtagaaacgcgcgagcgtctcatcgcggaactcgtcgaaatagccgccgtcgatcgaggcgcggatgtcgtcgagcaaatgcacgaagaagtactcgttgtggatcgtggcaagcgtgaacccgttcatctcgtgcgcacgcagcaggtggtccacataggcacgcgtgtagtgcgtgcacgtgtagcactggcagccctcctcgagcggaccgaaatcgtgcttgtactgcgcgcgcttgatgttgtaacggccgtcgcgcgtgaagatcgcgccgttacgcccgcaacgcgccggcgccacgcaatcgaaggtgtcgccgccgttctccacgcaggcgaagatgtcgtccaccgcggcgatgccgagcacgtgccggggccggctttcgggcatctcgtcgcagatccacgcgcagatgtcgccgatgatccgcttctccatcgcgccgcctatgccgacgccgtcgaagtcgagcgaggcaatctgcgaggccgcatgccggcgtagatcttcgtagttggcaccctgcaccacaccatagagtgcctggtacggcttgccaaggcgtgactgcgtgagccgctcgtgctcggcgacgcaacgctgtgcccagcggtaggtgcgctcgaccgagttctcctggtagcggcgcgtgttcatgagcgtcgtgagctcgtcgaatgcgaacatgatgtcggcgccgagcttgtgctggatgttcatcgaaatctcggcggagaatcggtgcagcgagccgttgagcggcgacttgaacgtgacgccgtcctcgtccacgaacgccatgcgctccttgccttcggcaatcacgtcgtcggacttcatgcccttcacatccatcgccaacgtcttcttgaagcccgcgccgagcgaaagcacctggaatccaccggagtcggtgaaagtcgggccgttccagttcatgaacttcgcgagaccgcccgcctcgtcaagcacgtcctcaccggggcgctcgtacaggtggaacgcgttcgacagcagacactgtgcgccgagctgggtcatcgattccggcagcacggccttcattgcaccttgcgtggccaccggcacgaatgccggcgtcttgatgtcgccgtgtggcgtgtgcagaatgccggtgcgaccatagcgggcgccgcctttgcccttgccgttcggggaatcaggcagtcgcgtggtctgttcaaaacggaaggcgctgcggtcgccgggtttgcccggttcagcgccgcgcggatgctccaccagctgcggggccggtgcctgcacaatgctctctgtattcgctgtcatgtgcgcaattctaaggcgtgcggttgtccgcgtgaacagattgcgcacacctaccgatgctaccgcccgtcgcatatgcgcctaccgtatgcgtcgccctcatgaggaagcacgttcgtcatcaatctggacaagtcggcgcagccaccgctgaataagaccatgattcagcgaatgaagcatgagaccctcgccgaacttctcctgacgcaccacgtatatgatcatcgccatcaccgtacgtgcgtcgtaatccgcggggtccaccacgtcgatcggcgcgtccagtaacttggcgtggagcaatcccaggtaatcgaagaaaccaaggtcgggctgcctgtcgagcacccggtttacctcatccatgaaccgcagaactatgccgttgtacgacacatagaatggattcaccacgtcgccgaactcacccatgctctcgagcatgggcaggaacttcgtgacagactcgtaggggtgcggggttcccattcgcgaaagcgccacacgttgcacatgcgacgggtgagacagcagttgcgtgagatcctggtcatgcgccatcgcctcacggcgttcacgggcaaaccaccagaaatacgttctcgcgattgcacgcaggtatgtatgcgcgaatctatacaaatcgcgcgcctgcatgagatcgatctcgcaacctacgccatattccaggcagcgagccaatctgagtgccgcactggccttgatgtaatgcatggcgtgacgctcatcgaccagcgcatacgcacgccggtaaagctcgaatgcggcgctctcgtcccgttcgcacaccattccttcaatacgcaggtcaccgaggaataccaacgcctctgggtcgccgagctccgccgcccgttcaaaacagatgcgtgcgcgctcgccgatcggcggctgttcgatcatcggcggatgccctttgatgctcgccgtgtagtagctattgaaataatcgccgttgttaaggtcctccttgtagattttcccgagcgcgacccaggcacgggcgtcaccacgaccagccgcatgccgaaacagaatctcggcgagcttgacacaatcatggaaccgctgacgttcgtcttcgtcggagtaagcgcgatgcacgcgcatcgcctcctccatatagaacatcgcgcgccggtatgcctcacggccgtgcggatcgaataccgaagccttatcacagtaatctccggaatcgtcgaggctggaatagaacggcgttcccggtagattcctgtaactctccacccaccgctcatagggcaccacggtctcgcccatcacattcaccggagatatgggcaccggttcgatccgcatggtggaactcttcggttcgtccgggccccagtcccaccacgtgcctccagggtaccggcccacgcgttcgcgcccatagtagtgcggtttgccctcgttgtccgtggcgaacagcggattggtgaggtacaccgccggcaataccggaccgatcacaatgtcggcgaaacagtaatagtccatgccgtattcgagaatcggcaccttgctgcgactctcgatgaactccccagacggctcgaatcccttctcatgttcgtgcaggaattcgaaatcttccatatcactgtcccataccatggcacaagattagcaaactgagtcaggcaacatggcactgacccagattcggcgcgttcgtctcgctctatcggccatttttcgcatatcgtcagggaatggccgccgagtgacgtgccacagcggccgttcttcgcagataggaacaaatcggccaacggaacgcatccaatgtcctcgcgaacaggatccccccaatcacaccccatgtcagccctgttcactctcttattttcgattgttaggtggccctctccagtaacagacccctaaaacacccaaatatgcgacaaaaaacgtagatttgtcgtatttatgcggcttgcaggcgggtgtctacttgcggaagcacctaacaatcgcagatagacagaaacacccatcttcgcctgaccggccagatttcacagcagcacacagatgagccgatggagcgcaccgcacgaccgagttgggggggcgatcggcactgacggcacttatgagaccgggagcagcagcgcgcgaatctgctcggcggattcgaaacgcacggcatgcaatccgagttcgcatgcggcggcggcgttggcggcggtgttctcgacgaacagcgtgtgcgcggtgtcgagatggaaggcgcgaatcgcacgctcgaacagtgcgggatctggtttggcaatgcactcgcgcgcggagaccattgtgccgtcgagcaggccgagccacgggtatttcacctgcatctgctcgaccgcggtctccgagcagttcgccaggccgaccatgcgcacgccggcggcccgcagttcgcggagcaatgtgggcatgccgacgggcatatcgtagaatccaagcgcgcgatgctgcagcagcaggcgcagaatccagccgaccgcgggaccgtgctcgcgggtgtagtcgtcgagaatcttgccatccggcacaccggcggcggcgcgcgcacggcagaattcgtagccgtgcgggtcatggtcatcgaagaacatgtcggtgacgccgggcgggtagaacgcgcccaccacgcgatgcgggcgccagtccacgagcacgtcgaaatagtcgaacacgacggcggagaaatcggtctgcacactgcaagcgtagcggacaatgcggtctcgtgaattccaaagattctttttcgaaagaacaattcagttttcagtggacattcaggaaacttcaagaagacgtggcttaactgagtactatcacaagaatagattgcccgagcgcgatcatgaggagacatatagggagagtcgatggctgacgacaacaataattggcctaccggcacgccggaccagaacgcaggctccgacgagcaccataccgacgccaacattggcgcgaacaccgaagatttgaacacggcacctgccgcacctgcagacgaacagccgacctccgtgctgacgccggtttccggttccgccaccgagcaaggcgagaagaacgactcgacttcggtggacgggacccgcaaaccggaaccgtaccgcctggcaccacaatatggtgcgtacgcgccgacatcccagcaggagacgacgcgcatcccgacgcccccacagcagggtgcgccgaacgcacaacagtccggactgccgtaccagacacagaacaatccgcagaacatgccatatggcgtgcgcgtggaccagaaccagccgaacgcgccacagggtgcaccgaatgcgcagaaccgcaatccgtacggtgtgccaacgggcaatccgttcgcgcccagcaacggcacgccggcaggtccgggcaatccgaacggcccgacacagtcgccgttcgggccgggcagcccacagcaggggcaaccggcacgcacgccgagcaacatcattgtcgcggtggtcgcggcactcgttgcggcggcgatctgcctgggcgtcggctatgcggcgctcaccaacggctgggtgaaaatccccacgtcgagctcgttgagcagcgtctcgtcaaacaaccacggttccggctcggccacggtggaaggcggtcaggcgccgaactgggccagcgtctccgcgaacgtgtcgaagtcggtcgtgtcgatccagaccgttgtggaccagggcgaagccaagggctccggcgcgatcctcgacaaagagggccacatcgtgacgaacaaccacgtggtttccggcgccaagcagattcaggtgacgctcgacaacggcgacatctacagcgcgaaggtggtgggcaccgattccacgaccgatctcgccgtgatcaagctcgacaatccgccgaaagacctgacgcccatcacattcgcgaattccgacagcctgacgccaggtgagccgatcatggccatcggcaatccgctcggctacgacggcaccgtgaccaccggcatcgtctccgcgctgaaccgacccgtcaccgtgatggacgaagagaacaacaacgccatcgtcaccaacgccgtgcagatcgacgccgcaatcaacccgggcaactcgggcggccccaccttcaatgcggcaggtcaggtgatcggcatcaactcgtcgatcgcctccaccgcctcgagcacccagaccgccggttccatcggcatcggcttcgcaatcccggcgaatctggtgaagcgggtcgccgacgagatcatccagaacggcaaggtggagcatgtggcgctcggcgtcacaatccagagcgccacggtagaagcggatggcgttacgcgcggcggcgccgtggtcaagtcggtcgtcgcgaacagcccagcagccaaggccggtgtgaagaccggcgacacgatcgtgggcttcaacggcctcgccgtgaacaacaactactcgctgctcggattcgtacgtgccgcagcgatggggtccaccgcgaaactcaccgtggtgcgagacggtcacacgatggagctcaacgtgaccttcgaccaggccgaggcggcggtgaacggcagcaaccgcaacgagaaccagaacaaccaaaacggccagaacgaccagaacaacaacggtcagaacgaccagaacaacaacgacggcaatagcgacaacaacaatcgcaaccgcaacaacgacgggctcatcgatccgttcggcatgtggtaaaccggcggcgaacatctgaatcggccgtttcagcgagagggtctgcagagcgatctgcagaccctcttcccatatcacctataccggaacacgccagtgggtgtggtttgctatagtgagaacccatgcgcggcaaacgcgcgaatacaactgaatatgcaagcaatctttttacgccgtgtgtcgtaagcgcaccaagccgggtgccgtgttcgatgggctaacaaggcgtgaagctagctttccacatctgtatgcgctatggcggcgtgcaggtgcggaagacgataccgacgtaaggagatgcgatgaagaaaatcatcgatctttgcaaggaagtcccgctccttcctctcaccattctggcggccataccgctggccctcattccgcagtggcgcccgtggggccacattcaccccgcattcgacccgggtgtgggcgaatggatcatcatcctgttcgtggcatggaccatctacacgagcatccgcgagatgatcgacagcattcggcacggccacattggcgtcgatctgctcgccatcgtcgcactcgtctccaccgtctgcgtacagcaatactgggcgtcgtgggcagtggtgctcatggtggcctccggcgaggcaatcgaatcgtacgcgcagaacaaggcgcgcggcaatctcaccgcactcatcaaagcggcgccgcaacaggcgcacgtggtcacattgcccggcgttgcagacggcggcgaggcgcaactgaccgaggaaggcttccgcaaggtgcagcaggccgtcgagcaggcgcagcgcgaaggcaagccgatcaccatgggcaacggtcatttcgacacggtcccggtgaacgacgtcaagctcggctcggtgctcatcgtgctacccggcgagattgtgccggtcgacggccagctgctctccggcaccgcaagcgtcgacctgagcaacatcaacggcgagccggtgccgcgcaccctgttcgtcggcgcgaaggtgctctcgggctccatcaatggctcgaccacgatgatgatccgcacgacgtcactcgccgcggattcgcagtaccagcagatcctgaagctcgtctcgtccgcggaggagtcgcgcgccgccgtggtgcgcaccgccgacatgctcgccgtgccgttcaccatcatctcgttcgcgattgcaatcgtcgcgtggatcgtctcgggcaccggtctgcgcttcgcccaggtgctcgtgctcgccacgccatgcccgctgctcatcgccgcgccggtcgcgtacgtcgccggcaccgcacgcctcgccaagcagaagattctcatcaaatctcaggatgtgctggagaatctgggtcgcgtcacgcatgtgttcttcgacaagacgggcacgctcaccgtcaagcagccgcaggtggtgcgcgtcgaaaaggccaaggacatgcctgcgaacgtctccgaggacgagatcctcatgctcgccggcatggtggagggattctcggtgcacgtgctcgccaagggaatcgtcgccgccggcaaggaggcgatggcacgcttgcacagactccccagctcaagcggcaaaaccgcagccgacggtgcaggccagcgcgaactgccgaaccccaacgagaactacccggtggtcggcaacgtctccgagacgccaggcaagggcgtcaccggcacggtggacggccacaaggtggaggtggggcgtttcgccttcgtgacggagcaatccatcgccagcgaggaagtgcacaccgcgcaggaagaggaacgcaacgagaaggcgatggagcaggcggaccgcgaggcggcgaaactgtggcccaccgagctcgaacccgacgagatggccacgtacatcgccatcgacggcaagctcgccgcgcgcatcgtgctgcgcgacgtgccgcgctacaacgcgaagcagtcgatcgcccaactgcgcgagctcggcgtgaaagaagagacgatgctcaccggcgacaagaaggcgtcggccatgatcatcgcaaacgaagtgggcatcaccgacgtgcgctacgaactgctgccgcaagacaaggtgaatgccgtgcgcgaggccgctgccgccgagaagaccggccgggaatcgggctggaagcgtttcctggcgaagctgctcggcgaaccgattcaccgcgatgtgacgatgatggtgggcgacggcgtgaacgattcgccggtgctcgcggtcgccgacatcggcatggcaatgaccgacggcacgtccacggccgcctcggaaagcgccgaagtggtgatcatgaacgacgacatcggcgccgtgccgctcggcgtgaagatcgcccggcagaccaaacagcgcatgctgcaggccgtgctcatcggcatcgcgctcgcgatcgtgggcatggtgtgcgccgcgttcaacctaatccccgtggtcgtcggcgcgttcctgcaggaggcgatcgacgtcgtctccattctgtgggctctgacggcactgttcaaccgcaagcaagcgagtcatgctggcatccgtacttgatttgtctcaatccgggaaatctgcgagacaaatcaagtacgcagtgccgggtttgtcacgctagccctcctctcagcgagacgaacctgacactattcgcactggtttgtctccccagcccttcccccagcgagataaatcaagtgcgcgactcttcacagattcgcgagtgtgggctaatctattctcgtgactcaagattctgaacttcgtattgctgttattggcgcgggcccggccggcgtctactcctccgacatcttcctgcgccagctcgccaagctcggcgacgaactcggactcggcacggacgcgcgcatcgatctgttcgagaaactgccggtgccgttcggcctcgtgcgctatggcgtggcgccggatcatccgtcgatcaaattcattgcatcggcgctcgagaaaacgctggataatccgaacatccatctgtacgccgacgtcgagttcggcaaggatgtgacgctcgaggatctgctggagcggtatgacgcgattctgttcgcgaccggtgcgatcaaagacaagccgctcgcgattccgggcgccgatctcgacggcgtgtacggtgccgcgcgctttgtggagtggtacgacggctacccgaccggcgtgcgcgaatggccgctcgaagcggaacgcgtcgcagtgatcggtggcggcaatgtggcgatggacgtcgcgcgcgagctcatgcgcaacgccgacgatctgcgtgcgaaaaccgacattcccgacaacgtgtacgagggcatcaagaacaacaaggcgaaggaactccacttgttcattcgccgcggcgtcgcgcaggcgaagttctcggtgcaggagctgcgcgaaatggagaaactgcccggcgtgcagctcatcattgacgaagacgacttcgaactcgacgacgacaccgtcgaggaggccggcaaagacaagctcacgcgccagatggtggaggagctgttcgtgattcgcgacatggccgaagacatggaagacgacggcgacgttgacttcgaaggcaacccggccgaccgcaagtactacatccacttcaattccgcacccaccgagattctcggcgaagacggcaaggtgagaggcattcgcgtggagcgcaccgagaccggcgcggacggcaagatgcatcgcaccggcgaattcaccgactatccggtcgaggccgtgtaccatgccatcggctacaagccggaatcggtgccgggcatcgcctacgacgagggcggcgcgcatttggccaacgcgaacggcgacggccgcatcactgtggatcatgagaacggcgaagtgcgcgaacgcctctatgcgacaggctgggcgaagcgcgggccggtgggactcatcggttcgacgaagtccgacgcgctgatgatcgtgacggccatgctcgaagacctcgcacagaacaaggagaacgcacgtctcgcgcccgaccgcgaccccgagtcgatcgaccgtctgcttgccgaacgcggcgtgcgaccaatcgatttcgccggctggaagcgcgtggacgcgtacgagcgtgccgaaggagccaaggagggccgcgagcacaagaaagtgatcgatcccgaccagttccgcgcactcgcacacggcgagtgaacgccagatgttcagcgggcgggtgccaggcgttcgcgaggtcgagcgtccggcgcccgtttccatgatcgtgttgcaacacgccgaattgcactattgtgagcattggtgtaatctaactctttgtctgcgagcgtggcggaatggtagacgcgctgtcttcaggtggcagtgagctcatgctcgtgcgggttcaagtcccgccgctcgcactagcaagaaacggctgatttccaacgaagtcagccgttttgctttgccgacgggggctgtttcggcaacaatttagcaaaattcgagagccgtctgagggccattcgagaaccatctgggaacacccccaccaccacaggtcattatccgttacgggatgtcactattctttacgggatgtctggactctcatggcatcgctgatttcggcgatagagtctaccatttcacaacacacagagagaggaaaacaccatactgatgcactctttgcacaattccgcacaacgatatcaaggaccagacatcccgtaagaaataatgacatcccgcaaaccacacggcacgaatacccgggacttgcgcgcgtagcacaccggcaggcatgcttcctgaacgtcacccgtgcacagggacaccgtcgggcaccgcgcacctactgcgcgctcaaaacggcggaattccaaacaaaacagaatatcaccacagcacaaagcgatacgcggccgtcgcacctcccgtagagtgaaggtattggttcatcaacaactgaaagaatggacaccatgttttggatttggacacttattgtaggcgcagtcatcggagcgatcgcaggtgcgattaccaacaacgggcattcgatgggctggatcagcaacattctggcaggattggccggttcggcgcttggtcagggactcttcggctcctgggggccgtcgctcgggggcatggcggtcgtaccgtccgtcctcggcgcggtcattgtggtcgccatcgtcagcttcatcgtcatgaaggttcgcgcatagcaatctgccgaactcaataatctggattcgcgggacccggctcaaccggcgccccgttttttcatgcctgagctgatgcacaccgtgaataaagactgaatattcacgctcgtttatgatatgcgaagcgtgtagcacactgcaaattttcatgtggttgttttatctcaaaactgcatagtttcacctcatagcccaaataaacacgacccgcagtcgcgcattttacaatcccaaatatccgtatatataacccaaaatatgaataattatgcattggttatgggttcttattgtcggagcaatcatcggtgcaatcgccggcgccatcacgcatcacagcggtgcaatgggccggatcagcaacatcatcgccggcctagtgggttctgcactcggtgaggcgctgttgggtcactggggaccgcagcttgccggcatggcgatcattccgtcgttgatcggcgcgattgtcgtcgtcgcagtggtttccttcttcctcatgaggtcttcagcaaagaactgacctcacttgtagccatcattgggggctgcggttccaccgggggccacagcccccaacactatctcactgtctgcgtaagaagagacatctgcactccttatatgtcccaaattacgcaagctggaacctatggaagctacacaaagctgcacgcagcaacataatctgcgtaaaaagagacagttaggccggctaactgtcccaaattacgcaattcaagacagtgacgcatttcaggcattccgcggcgacggcatcttccaaaatttacgtaaaaagagacatctatgctccctcaacatgtcccaaattacgcaggcgaaaacctgtgcactccgcaaatccgcaaatccgcaaatccgcaactctgcaactctgcaactctgcgtaaaaagagacatcttgtgcatctttctgtctctttttacgcagaggtgggtatgaccagaaccatctataatcacgctataatcacgctatagtcatggatctcccccgcaatcacccgcacacgctgcccacgaggatctccgcctccacggtgagctcatgaatccgggagagatcaagcgaatccacgtccacgttgaacagcaacggcgtcatgcgggcgaaggcgagcacatcgtcggccggcatcgggaaggtctgggagacgagccggcgttccagcacatcgaaatgctcggcgaactgccccacaacctgctcgttcgaatagtcgccgtggcgcagctggccgcgtgcgagctcgcgcagctgctcgtcatgccgcgcgccgggcaccaccttgatcaccacgcccgagccgccgagcacgcgcgtgaattccgcgtagttgaccggcgagaacacgtcgagcacgcagtccacggcgccgtcacgcaccggtagttcggccagattccccacaaaccacctcaccgcgcaccccgcgtcttcgcgcgccgccagctgcacggaatccttggagatgtcgaacgcgagcaccgtggcatccggatgcgccgcctgcacggcgcgcgcatagaatccttcgccgcagccgacgtcgagtatcaccggcgcgcgcatctgcggcccgctcgagcgcagatccgcacgcccgcgtgcgccgcgcaattgcgcgccggaacgcgtgcgcaggcccgcgaaatcgatggacgcggcaatctgcccgcaataccgccccacggcactcagcacggcgtcgacgatatgcgagtaatagccggcggagagaatctgcccgcggtgctcgaacgactctctgctgtaatattccgactgccgcgcaccgggcgccagattcacgtacccctgccgcgccacgtcgtaggtgtgaccgcgttcgcaacgcagactcgtaccctccagccgcagctcctcacggcacagcgggcacacgaagtatttccaggaatccgcaaaccgcgccaatttctccggactcatcgcgacctcccgtcacaccgtggaatcccagcacatcgtaacaaaaaagcctcccggaggaggcctgtggaacggctggtcagtcgtgcgggcgcgtgttcagcctgctgtagtagaacgacgcgagcacgcagaacacgagcgtggcgatgttgaagatgagctcgacccaccacagaatctggttccacgtgttgctcagcggcccgaacaggccgggcagcgtgacgagccagctgatgatgacgcaaataaatacccagatgccgtatttctgccccatctgctggtcatagagatgcgccggcgtgagctcgaaattcggcttgttgttgtacaccgcgtacacaccgaacaccagcagcgcgaccagcacgatcacgttgaggactgtcatgatgatgttctgcgctaccatgacgcttcctttcctaaaattcctgtatttcttccacagattctaggctcaccctccccgcccccgccctgattacgcgcaccgcgctacgcgttttcgactctgacagccgaatatttcacgtgatatcacgcgcagactacgctggtcttcagtttcacccgacgaaaggcagcccatggaaatcgcgatgatcaacgaacacgaattccagcaggatctcgaggccaccgccctgccggccctcgattcgtgcatgcatgacggctacatggacccggccgtctcggattggcatgggcacagactgcgcacgctgcacccggcggacggcactccgaacaagctgcatgtcgtgcgctacgacgtcgagaaattccatgccttgcagattcccggctcctcccgccaaacccatggcaccgtgctcatctcgcacggattcaccgagttcgcggccaaatacaaggagatggcatggtacttcctgctcgccggattctccgtttgtattctcgaacaccgcgggcatggctattccgcgcgcgatgtgaggaacgaccagattgtgtacatcgacacatggcaccgctatgtcgccgatctcgcgaaatgcgcgcggacgatcgcacgcccgatggcggcagacaagccgcttgtgctgttcgcacattcgatgggcggcggcatcgcagcggccatgctcgagcggtaccccaacatcgtcgacaaggccgtgctgtcgtcgccgatgatcgaggcgaatctgcacaccccgaactggctcgcagcactggtgtgcggcgcggcatgcgatttcggccacgccaagtccatggcacccggacagcgcgcgttcacgccgctcatcgacatcaaagacaaccagggcgcatgcatgcagcgtctcgaatggatgaagaagctgcgcatcgcagacacgcattaccagacctcggccgcggcgaacgagtgggtgaggcaggcgatccgcctgtccatcgccatgcaggacccgcatatgtgcgagcgcatcgagacgccaatcctgctgttccaggcaggcaatgaccactgggtgcgcaacaaggcgcagaatcgcttcgtcaaacgcgtgggcaaggacggcggcgacatccgcatggttcgcgtgcccggctccgtgcatgagatcttcacgatgccgaacagcgtgatggcaccgtatctgaaggagatcctcacgttcctgcaaacgagcgagccggtcaccgtgctcgtctgaactcgggcggggcgcgccgccggggccggtatttcacggcctgcgcgatactatgcgtgcgagagatgagcggaaggagccccggtgtctgaacacagcgatccacagcacgaccacggcacacgcaatgtgaattcgccggaggaactccatgagatgctggcgcggtcggcggccaccgagcaggctgatgcgcgcgacgtgctcgtcgaggaggcggtgtcgggcaaaggagagcagacgccctccttcgagcagacgccgcggaaaatggccatcggcattgcatgcgtgctcatcggcggcacatgctggggcgtcaatggcgcggtgtcgaagatcctcatggaggaataccacgcggctccgctgtggatcgcctgtgtgcgcgagatcatcgcggggatcatcttcctcgtggccgccatgatcggcacaccgcactcgctcaggtcggcggtgaccagctggcgtgaatacccgaagttcgtgggcgcggcgctcacctgcgtgacgctcgtgcaggtggcctacctgttctcgatccattggacgaacgcgggcaccgctaccgtgctgcagacggtgaatctgctcatggtgctcatctatgtgtgcgtgagggcgaagcgcaggcccacgaaacgcgaggtgatcggcgtcgccttggcgttcgtgggcgtgtggctgctggccaccggcggcaagctgagcacgctgtcgatgccgctgcccggcctgttctggggccttatggacgcattctcctgcgcctgcctcgccatcattccggtggggctcatcgcccgctacggcaatctcaccttcaacggccttactttcctcatttccggactcatattgctgccgttcgtcaaaccatggcagaacatgccgcatttcgacgcgcgcggctggtggctcatggccttcacggtggttgtgggcacggtggtcgcgttctggctgttcatggcgggcgtcgtgcgcatcggctcgatgcgcgcgacgcttctggcgacgatcgagccggtgaccgccaccatctcgtcggtgttgtggaccggctcggtgttcacccccgtcgacatcgtcggattcgtgctgatcctcatcatgagtttcctggttcaatagcccgtgacagccggacgggtgggcggcgcccggtatgcctacctcgcgagggcatcggacaggaagtcgcgctgcagaatcagcagattcctcgccacatccgggtcgttcgtcatatgcgtgatcccggtgagcggcaggaaggtgtgcggccggccggcctccatgagcgcctgactcagccgcaggctatgcgcgatcgtcacgttgtcgtcggcgaagccgtggatcagcatgagcggtcgaacgagcttcggcgcgtccaacacaatgctgttgtcggcatacacctgcgggtccaggcccaggaagcgctcggtgtagcaggtgtcgtacagcgtccagtcagtcgggggcgcgcccgcgcaggctgcggcgaacgtgtccggggcgtcgagcaccgcgagcgcggagaggaatccgccgtacgaccagccgatcatcgccacgcgctcgagatccggcttcggcaacggccgtgcagcatcgtcgtgcccaccgaattcgcagccctcggccgcgcctcccatcctattgagctcgtcgaccgcaccggccagcgcatgcactgcgtccacctgatcggccagactcacgcgcttcatctgcaaatacacttcgcgatcccacaccggtccgcgcccggtcgtgccgcggccgtccgcaatcaccacaaggtagccctggtcggcccaccactgcgcgtccaagtaggcggcccggctcatgaccacctcctggtgccccggtccgccgtacggatgcatgagcaccggcagctcggcggcgccggcgaaccggctcgacgcgctcggcgccacaatcgccgtgaacagcttacgttcaccgagtcgcacgaagcgcacgttcggcacgaagtcaggttcggcggcgacattgcacacgtcgtggcccgtacgcgcgccctcagccccgtatgacaggcgcatcaccgctttcgccgaatccatggtgcgcccccacaccacgagtccgtcgccgcgtcgggacgcacgccacacgcccggctcgtcgctcaccgcgcgcaccgagccatcggcgtacgatatggtcacaatgtcgaaactgcgcgcgtcatggtagcgttcggcagtggaatccgcccactgctccggcacctcggcggcgcgttcggccgtgcgctgcaccacgcacaacacatcgtcggtacccgcgtcgagcacttcgcggacttgccaccccgccggcgtgaacacacgtccatccacgctcaaccgattcgtgtcggcctccatgtcgttcaccgaacacaccacggcaccggacggtgtcacacacggcgttccacccaccagatcgatccactggtcgttgtgatgctcggcgatcacctccaccggcagcaacgccatcacattgccgtcgagtgcgcgcagatcgccccactcgttctccgctggcatggccacgcgcagaatctgctcatgctgctgcaagcggtcgagcacgcgcagcacgggtcgctcggcctgccaatccaccacggccaggtattcgtaagccacattgtcccagtcgatcatcgccgtcttctgcaccgacgtgccgtcgtcgcccagccgcacggcgaacagatcgaccacggcgttctcggtgagcgcacgcgggtaacggtgttggatgccgcgcgccgccggatccgccggatcactgatcgtccacaccggctcgggcgacgaatcgaagcactccaccagcagtgtgcgcgaatccggcccccaccagaacccgtcgtagcgatccatctcctcgcccgcggcgaattccgcgagccccgcgcgcatcgtctcgcgatcctgtggcgataccgtgaacaccgcgttcgccactgcggtctgcacatccacgacgaccaccgcggatcccgtcgcgtatgccacgcgcttgccatccgggctcatccgcgggttcagcacagggccggcgaactcgttctgcgcggaatctgcgaactgcggcacgagatgctcggtacgcacgccggcgcccacctgtgcgcgcacgccgtcatctcccaccgtgtacgcgagcgcgtcccaatcgattgtcgtcacgaacagctcgccgttcacggtgaaggcgacatgattgcccagaccgtccaccgagtacgcaacgatcccggtggcgctctccctcgcacgttcacgacgcgcacgctcggcagcaggcacgtcgtcgctgcccagtgtgttcacgagctcacccgcgttcacgagctccacttcggcatacgcgtcttccccgcagattgccagccacagcgaattctcggtgtcctgctcgcccgcggaccgtaggaacagcatgcgcgatccgtcgccgatgagcttgggagagcgcggcgccccgcatgtgaaccgcaccgttttcgctttgcgcactgggtattcttcgattgcagattccatcccgcacctctcgtctcatcggatcatctattcgttcccactctatcctgcttcacggaaccttccgtaaaacaggtcgcagactccccttcccgcggcacctcccacggaaccttccgcaataccgaccactggcgactctcccggcggcacagctcacggaagctcccgtaaatctgaccactggaagccccatcggcggcacagtttccggaaccatccgaaaatcagaccacagatgaccttccccgcggcacattgcacggaaacatccgaaagactgaccacggcgacactgatttacggcacagcttgcggaaacatccgcagattcggccacaacggcacccatttacggcatggttcacggaaacatccgaaaaccatgccacggcagcgctgatttacggcacagcatacggaaccatccgtaagatctgccgcctaaggacacatctgcagaccactccacggaaccttccgaaaaccagaccatctccaaggctctccgcggcaccgctcacggaagcatccgcaatacagaccgcaaatacatcggccgaacgattgcggattcctgtgggtccggcgcatagtaggcaatgtggaaaccgcgggaacaaggtggggccgtatgcgtgcagtgaaacggcaaaccgttgcaatccatacgctcccagaggaaaacgcggcggaccgatgcgcctgaaaattcacacggttgatatataagcgtaggataggtaaggatagaaagggtaactatgagcgttcttgatcgttttgagaaaagcgtggagggtgcggtcaacggagtgttcgcgaagttcggctccaaagacctgcagcccgtcgatctctccagcgcgcttgagcgcgaaatcgacgccgaggccatgccggtcggccgagaccgcaccgtggcgccgaacgagtaccgtttcaaactgagcacacccgatttcgaccgcatcgaaagctggggttccgaggccatggccaatgagctggccgacaatctcacgcagtacgcgaagagccaacactatgcatttgtgggcccggtcgtcgttattttcgaagaggacctgcaactgaccaaaggcaacttcaagctcacgtccgaatccgtgcagggcaacgccgtaccggtcaccactgacgagcaggccgaggactgcccgatgctcgaagtcaacaacaaccaatacctgctcaccaaagacaagacgattctgggtcgcggctcgggctgcgacattgtgattgacgaccccggcatctcccgcaaacacctggagatcgacatcacggacaacggtgtgatcgcccgcgacttgggctccacgaacggcacgtatgtggagggccatcaggttcccgccgcgacgctgctcgatggcaacacgatcacgatcggccgcacccgcatcctgtactgggcctcctcacaagaccagaggtgagcgtagcgggatttttccatgattaccgaacttacctttgcggtactgaaatacgcgttcctcattctgttatggctgttcgtgtggttcatcacgcgttcgctgtaccgggatgtcgccgcgttcagcccacgcaaatcccgcgcacgtaggcgcaaggagcgcgaagtgcgcaaatcgaacgacgcgttggcggtgtcagcgtcggcccagccgttgcctgtctccgcacctacaccgtcggcggccgcgccttcggacaccgcacccacacctacgctgctggtgatcatcgacggcccgctcgccggcacctcggttccgctgaactcctcggtgatcacgctgggccgcgccgcctcgaacacggtggtgctcgacgacgaattcgtctcgagccaccatgcgcgcgtgtaccccgatccgaacaccggagtctgggccatcgaagacctgcacagcacgaacggcaccgtggtgaaccagcagcgcatctccgcacccaccattctcggcccgcgcgtaccggtgcgcattggcgctaccacgttcgaattgaggtgaccgcgagtggcagacctgtatatgtattccaccacggtttccgacgtcggcactgtgcgctcgaacaaccaggattcctcgttcgcgggcgagcatctcgtggccgtctgcgatggcatgggcggccatgccggcggcgacaccgcctccaccatcgcgatccgctcgctggcgcatatcgagacggattccgcgggcggcgacgtggccaaggcggcggcgatcatcgaggcctccacacttgctgcgcacgatgccatcgtgggcaaggcgaaacgcgaacgcaagctcgccggcatgggcaccaccgtcaccgcgatcacgctcgtctccgattactgggtgatcgcccatattggagattcgcgcgcgtatttgctgcgcgacggcaaactcatgcggctgaccaccgaccacagctatgtgcagcatctgatcgacacgaagcgcatcaatgaggtggaggcgcgcaatcacccgcagcgcaatgtggtcatgcgcgtgctcggcgatttcgacatcgacgcccaccctgacatctcgattcgccgcgcagaggccggggaccgcctgttgctgtgttccgacggcctgtgcggtgtgctcgaggattccacgatcgaggagacgctctcgcatttcaccgatccggaggagtgcgcgcagaccttggtttccatggcgttgaaggcggggagcaccgacaatgtgtccgccgtgatcgcagattccacgatcgccctggatgccgactcgttcgatctgccgcatcagactccgttgatcggcggtgccgccagcgcgacgctcgaaccgattgcagacatcattcatgaacccgtcgcgtccgcccccgcgctgatcacacgctcgtcaccggcggagcgtgccgccgcgctgattgcgagcgacagcaacaaggccgcgcaatccgaggagcacgacgccacccagcaggtggcgcagccgtcgacggtgcgcgaggagaacggcgaactgcaggatccagacaccggcgagattccggtgatccgcaaatccgacggccgttacagcgcggacccgaacgacccggaggtcgccagggccattcaccacgagcatctgcaggagaagaagcaggcccgttcgcgcaggtttcgcggcaagatcattggcagtgtagtcgccgtggccatcgtggccgtgctcgcgctgggcacgtgggccgcgtatgcgtggagccagacgcaatattacctggcctccgacaatggtgtggtcaccgtgtaccaaggcgtgccaacgaacatcttcggctacgagctttcgcatgccatcgagcacaccgacctcaaggtcgatgagctgcccgagcagtggcaggaccgtctgcggcagggcataagcgtggatggctacgacgaggcgctcagccatgtcgagctcatacggacgcagttcaacgacctgaagaaggagcaggaacagaaggcgaaggaagacgccgacgccaaggccaagcagcagaagcaagccaacgacagcaagtccccgacgaagtcggcgcaaagcaggtgattatggccgctcgtgttcgttaccttctgcagatcatcttcgcactgctcatctccgcgctcggcttcttccagttgtccgagcgcatgaacggcaagcccacgtccggcagcgtggtcatgcagatcgtctgcgcgatcatgttcctagtggcctggggccttatgagccggttccagaagtttggcaaccagtcgatcttcgcatgcgtgctcatgctcacatcgataggtattctcatgatctcgcgcatcgacggcgagatggacaccgccgtggccatccgccagatgatgtggctgtgcctggcgctcgtctgctgctacgccctgttcgccttcatgaaggattaccgcattcttcgcagattctcgtatgtgagcatggtgatcggcctcgcgctgttgctttcgcccatgattcccgggcttggccgtgagatcggcggcgcgcgcatctggattggcgtcggctcctaccagctgcagccgggcgagttcgcgaagctgttcctcgcgttcttcttcgcctcgtatctgttcaaccaccgcgaccagctcgccgtcggcggcaggaaggtgttaggcctgcaattgccgcgcctgcgcgatcttggaccgattgtgatcgtgtgggtcgcctcgatgggcgtgctcattctgcagcacgatctgggcacttcgctcatgttcttcgcgatgttcgtcgccatgctctacgtggccaccggccgcgcgagctggctcatcatcggcttcctcgccttcgccataggctgtgtggcggccgcgcacctgttcgcgcatgtgggctaccgtgtcgacgcctggttgcaccccttcgactccgagatctacaaccggtaccccggcggctcgagccagattgtgcagggcctgttcggtctcgccgccggcggcctgttcggcaccggccttggtgaggggcatccggccatcacgccgctggccaactccgatttcatcttcgcgtcggccggtgaggagctcggtctcgtcggcgtattcgcgattctcatgctgtacctgctcatcatcgcggccggcatgatcacggcgatgaagatcaaagacggcttcggcaagctgcttgcctcgggactcgtgttcacgatggcattccaggtgttcaccgtggtcggcggcatcacgctcgtgattccgctgactggtctcacgatgccgtacatggctgccggcggctcctcgctcatcgccaactacattctggcagccctgctcatcatcatctcgaacgccgcgaacaagccgcagaacgacctgatgaccgacacgttccgcatggaggccgtgcacgcgctgagcagccgcaagccgcgccagcgcaaggcatccggcaatgccacgcaggtcacgaaaccgcgcggcaaccgcgaggaggagcctcgcccgcgtacgagccagctgccggtcacctcggcggccgtccagcaatctgcagccgtcagtgcgtcaccggcacaagacgattcggcaacgcaggtggtctcaccgcaaccgattgtcgcgccgcagcagacaagcgagccggtgtccaacacgaggaacatcccggtgtcgccgcagcaggcgacgccatcggcaggcgaggagacggaggccatggcaccgctgaatccgagcgtgccaccgctgccacagcagccccatacgccaacgaaccatcaagcaaccacaagcgaaggaggtgccgagcatgaataagacattgcgccagctgttcacggcggtcatcgtgctgttcgtgatcctcggcatctccagctcgatcatcatggtgaaccgcgcgaaccggctctcccacgattccaggaacacacgcgcgctataccagacgtacggtgccccgcgaggctcaattctggcgtcggacggcacgattatcgcgaaatccgacccggtgaacgattcgttctcctaccagcgctcctacccgcagggtgacatctacgcgccaatcaccgggtatttctcgatcgcacagaacgccgaccgcggcatcgaagcctccgagaatgagctgctcaccggcgaatcgaacgcattgttctggcagcatgtcaaggcgttgttcaccggcaaggagaacaagggcgccagcatcgagacgtccatcgatcccaagctgcaaacggccgcaatggaggcgctcaagaacaacgacggcgccgcggtggccatagagccgaagaccgggcgcattctcgcgatggccagcacgccgagctacgacccgaacgagctggcctcgcacgacaccggctcggtgagcaaggcgtacaccgaactcgtcacgaacccgagcaatccgatgctcaaccgtgcgatcagcgagctgtatccgccggggtccacattcaagacggtcgtggcggcggccgcgctcgacagcggcaaataccagctcgacacgcagattccggccggcgcctcatacacgctgccgggcacgcagacgcagctgacgaacgccgaggagccgggcaacggcaccgatggcaagatctcgctcaaagacgccatggcgtggtcgtcgaacaccgcattcgcgcagctcggcgtggcccttggagacgagagcgtgtcgaatatggcgaagaagttcggcttcgacaagccgatcgtgatcgacggcacggattcgaacggtcttcccatgcaggccgtggcctcgcgattccccaccaatgtgggcgacgacaggctcgcgctggcttcgataggtcagggagacacggtggagacgccgttgcagaacgcgatgatcgccgctgccattgcgaacgacggcaaggtgatgaaaccgacactcgtggaccgcgtgcgtttcagcgacctctcggtgatgcccgacacgaaaccgcaggtgatggacaccgcgttcagtgcggacacggcgaacaagctcaccgaggcgatggaggccgtagtgaccgacgcgaacccgaatctcgagatccccggcgtgaaggtggcggcgaagaccggcaccgcgcagatcggagcgaacaacagctcgatagacggctgggtgatgggcttcgcgcctgcggacgacccgaagatagccgtcgccgtggtggtgcacaatgtcgacctctacggctcgtttgcagcaggaccgattatgaccgcgattatgaaggaggcgctccaacaatgagattgattgaaggacaactcatccattgccggtaccgtctcgactcgcgtctggcccagggcggtatgggcgaggtgtggaagggctacgacattcagctcggtcgtcccgtggccatcaaggcgctgcgcaaagacacgacgaaccaggagtccaaactgcgccgcctgcgtgcggaggcccgcaattccgccaatctggcgcacccgaacatcgccgcgttgttcgaatactacgagcacgacggcatcggcttcctcatcatggaatatgtgccgagcaagtcgttggcagacctctaccacgagcttgatggccccatggacccgattcgtctgctgcctattctcatccagaccgcccgcgggctgttcgtcgcccactcgcatggtgtgatccaccgcgatgtgaagccggcgaacatcatggtctccgacaacggcgaagtgaaaatcaccgatttcggcgtctcctactccacgaaccaggagcagatcacgcaggacggcatggtggtgggcaccgcgcagtacatctcgccggagcaggcgcaaggccagcaggccacgccacagtccgacatctattcgctcggtgtcgtggcctacgagggcctgtgcgggcatcgtccgttcaccggggcgacgccggtcgacatcgccgccgcccatgtgaacaatccggtgcccccgttgccgaacaccgtggatttccagctttcccaattcgtcatgtcgatgcttgcgaaagaccctgcggatcgtccgcaggacgcgctgaccgtggcgcgtgtgctctcccgcatcgagcgccgtctgctcgaccagcagaccgcgctgagcgacaccaccatggtgaacatcaacggacgagtcccccgccgggtcacgagtgcaccgcaccatgacctgcaaacgtatcaatccgccttcccgttcgcgcagcagacgcagcgcgatgccggtaccgattcccccggccatgcgatcgccggaggctttggaaggagcatcaatgagtagcatgcctaccacgctcgataacggccgctaccagcttggccagctcgttggccgcggtggcatggccgaggtgcacatcgcactcgatacacgcctgggtcgcaccgttgccgtcaagatcatgcgcgccgacctcgcacatgacgagatcttcctcacccgcttccgccgtgaggcgcattccgtggcccagatgaacaacccgaacatcgtgaacatctacgattcgggcgaagaggtggtcacgctcgacaacgggcagaccgaacacctgccatacctgatcatggagtatgtgcaggggcagacgctgcgcgacatcatcaaggcgaacggcgcgctgagcgtctccgacaccgagcatgtgatgatcggcgtgctcaacgcgctcgaatattcgcaccgcatgggcatcatccaccgcgatatcaagcccggcaacatcatgatctccgagcagggcattgtgaaggtcatggacttcggcatcgcccgcgcgctcgacgattccgccaccacgatgaccaagtcgcagggcgtcgtgggcaccgcgcagtatctatctcccgagcaggcgcgcggcgagaacgtcgacatgcgctccgacctgtattcggccggctgcgtgctttacgagatgctcaccggcagaccgccgttcaccggcgattcggcggtggcgatcgcctaccagcatgtttcggaagtcgcggcgaagccgagttccattgtgcccgggctcaaccccatgtgggaccagatcgtggcgaaggcaatggccaaggatcgccagaaccgctatgccacagccaccgagttcaagaacgacattctcacctacatgaacggcggcctgccctcggcggccgcgttcaacccgctgcaggatctctccacgatcaacgcgaccaagacgcagacgatggcggcggcgaacgactaccccgccaacgaggggtccacacgcgtgtacaacccggtgacgggccagttccaaacggtgccgcaggatccgaatgctgcggccggcgacaccgacacaatggtgaagagccggtcacagaagcgtcttgaagcggcgcgtaagaggaaacgcaatacaatcatcaccgtggtcgtgctcgtggtgctcgcgctggccgcagccggtggatggtatgcgtgggcgcacatgcaaccgccgaagaaggagtacgtcaccgtgcccactttctcggccacaaccaccgaggaacgcgcgaaggcacagctcgcggagctcggacttcaggcatcgatcaagcaggacaccgattcgcgcgagccagccggcaccttcacgaagcaggcacctgccggcggccgcagcgtggagaagggcagcaccgtcaccgtctggttctccgccggaccgaagagcgtgccggttcccaatgtcaccggccaatcccaggccgacgcccgagctgccctcgaagccgccggtttcgaggtgaattcgagtgtgcagaccgaagacagcgccacaatcgaacgcgaccatgtcacacgcaccgaccccgcagccggcacctccgctgagcagggaaccacggtgagtctgtgggtgtcgtccggcatgacgaaggtgccgagcgggctcatcggcaagtcgaaggacgaggccgtggacgagctccagaagaacggtttcgccgtggagatcaacaccgagaactcgtcacagcccgagaacacggttacgcgcatcgagccgaacgagggcacatcggtggagcgaggcgcctccgtgaccatctgggtgtcgaacggcaaggtagcagtgccgaacgttgtaggccgtacactcggggaagccaaggccgcactcaccgattcggctctcaacctcaagtggaaggtggcagccaatagcaaagacaacgatgatgccgtagtaacagcctcgaatccgagcgcagggtctcaggtcaatccaggtaccgaggtgacactcaccactgagcccaaggaaagcccaagccccagcccctcaccgagcaatagcaacggcagcagcgggagcaacggcaactccggcaatggagacagcaacagcggctcccagtcctcgcagaaccagcagaacagcgacaacaaacactagcgccgaatcttccatctgcataaatggggacagaaccaccctcggtactgtccccaattacgcataacaactgcgtaaaagggacaaaaatcagcttcaacttgtctccaattacgcaaaaagacgacgtgaaaggggacatatgaaggatggttccgtccctttttacgtcgttgtttacgctcctgcccattatccgccgcgcgtagcgccgtggccctgccggggcggcaaggatgaggaacgtaaagggcgcgcagcgatcccgtgacgacctcttgccgtcccggcagggccctgaaagccgcgctactcggccgcgagcttcggctgcaggccgaggctcttctcgaccgcagactcctgaccgcacacggccagccagttcgcaaacaatctgtagccatcctgcgtgagcaccgactcggggtggaactgcacggcgaacaacggcagttcgcgatggcgaataccctgcacaatgtggtcgtccacggtccatgcggtcacctgcagctcgtcgggcacggaatccggctccgcggcgagcgaatgatagcgcgtcgcagtcatcgggttcgcgacgccggcgaagatctcatcatccacatgctctaccagactggtcttgccatgcatgatcgtcggcgcgtggctcacggtgcagccgtacacctcggcgagcgcctgcatgccgaggcagacaccgaacatgggcgtgccggtctgtgcacacaggcgaatcacgtcctcgctcacgcctgactcgctcggcgcccccggtccgggtgagatgagcacgccgtcgtagtcgtcgagcacaccatcttcgtgcgggtcgagcgcgtcattgcgcaccacggtcacggtggcgccgagcgtcttcaaatatcccacaatcgtgtacacgaaggaatcgtagttgtctatcaccagaatgcgcgcggaatcggtcatctcactcctcactgtgtctgccccgattctaccggcaggcaccccgcaccgcgcctgcatgtccactcatcacttcatcactgcgtagaagaagacagatagcaggccctatctgtcttctttttacgcaaagacagcagaagcgagggaagcagcagaagcaaaggaaacacaggaaacacatggaccgaaggaagcgagccgcgcgcagcacgccgcaatctgcaccccgcgctcgctctactgcgtgttcaccgctgtgtagttcgacatttcgcgcagtatttcgatatggctcgccgcccacgggcacgcccattcgatgatcgcgagcgacacggccacgaacagcaacagcgcgagcagccagcggattggcgcggggccgggctggtgccgcacgagcacgccgtagatgtccacatccggccgaggccggcgcccctcgcgaatcgcacgcagcagcggccagcgccaggcgatcgccgccgcgatgaagatgattgcgtacgcgatgagcgccccccagatcaccggctgcagcgtcttgagtttcgcgaagaacggcgtctgctcgttgctgatgaacttcgtcgcgccatccgcgccctttttggcgagttccgcgggcacgccgtcgctcaccttcgcccagtacttgaattcgccgaagctgatccaacgatgtgtcggcgcggtgtatttcggctcgcatgtggtcatcgtgagcaggcgcttggtcggcggcgcgctcgggtcctccgggttcgccgagatcaccgacgtctcgtccggcgtgacgatggtgtagttcgtgtaggtgtacacataccagtagtccttcgtgcgcaccacgacggcgtcgcctggctgcagcttgtccacgtcgccgagcggctgcccataaccgttgcgatgccccgcaatggcgaagttgcccacctgcccgggcatctgcgagtccacgtaatgcccgagtccgtgcagattgagttcggccaggtcggtgccctgcacgagattgcgctcccacgcatcgccgaagcgcgggatgtacacgcggccgatgagctcgcctatgctcgcatgttcgggttgcagcggagggtcgccctgctgcgggtgcgcgattttcgcattggcgccgtcgctggccggctgcgcccacccgacgctctggcgttcctcgatctgccggttctcggactgcacgcccgtccaccattgcatccacaccacgtacagcgcgcacaccagtcccacggtgagcagaatctccgcgaggatcatcaccaccgaccgcatgacgctccgtttgccccccacctccggaaggcggtcaatccgtccatcctgccgtgcggatgcgttaccacgcctgccgccgtgtttcatgtggcctcctcggggtcatgcatatccgtgttccggaagtctgtgtgaagtctgtagctgtatgaagtctctgtattgtatcggttttcaattcgtggcggaagtggtctgcccgccgttcgcagattcgttcgagccgcccgactcgaacgccttcgcatatctgagcggattgagcacgagcggcgtgcgctggaatgtgagcgagcggttcacttccacgtcgtagcccagaccgaacgcatccacatactgtttgtagatctggatcgcgcgtgaatcgtcgagcgactgcagcatgccgtccaccgggccgattgccgagatcgtgaacggcggcgagtatttgcggccctgcagcagcagcacgttgcccgagcagatcaccgcggacgtcggcagcacgcgctggtccatgatctgcatggattcggcgcctcctgcccacagcgcgtccaccaccgcctcgacgtcctgctgatgcaccacgtacttgtctatgtcggcggtggaaccggaactgtcgaccgcgctgcgccacatcgacgagtcgttcagcgtcacggtgacgcccgggccggtcacggcgggcagcatcgtgctttggcccgcctcctcgctgttgccgctttgcatctcgttgttgcgcagcagcgtgttgtagtcgtcgatctgcgagccgagcttgttcacttcgctttgcagttcgtccacgcgctgcacgcggtgttcgatgagttccgcggcgtcgttcgacacggtcgcggatttgttcacgcgcagattcgtcaccaccaggtacccgaccaacgcgaccaccacaagcacggccatgctccccaccaccgatgtcttcctgacatgcctggcaccgtgctttgccatcgccacctccaaatatggttgttttgctgaggtcgcggacgccctgggcccgctttcccacatacccactatgataactggtagccgattaaaggagactacacaaatggctgaggaagagctgcacaaaaccgacgcggatgtctcggcaaacgacgccgcagacagcaacgccaccgtcaccgacgacgtggtggtcgacgccgccaccgattccgaaggcgatgccgtggccgtggaatccgagacggtgaccgaggagccacagaccgattccgagaagaaggcggagcgcgaggaaaagcgcgccgaagacaacgagaagcgcgccgaggaggccgcggtggtctccgaggaggaggcagacgacctctcgctcgacaaaatccaggctgtgctcaactccacgattgacgagaaagacatgtctccgcagatgcgccgcatggtcaaacgccagcaggagaacacgaagcgcgtggaggagtcgatcaagggcacgaaggccaatccgagctggttcgtgccgctgttctgcgcgttcatgatcgtgggcctcatctgggtggtcgtgttctacatgaccgccaaatacccgattcccggcatcggtaactggaatctggccgtcggcttcgcgctaatcatgatcggcttcctcatgacagtcgcctggcgctgaccatctggctggcatatccgcattttctttttaccctatctccgcgtaaaaagagacagaccacagtcaattctgtccctttttacgcagagaacaaccgatttccctatccttttctcttcttcttctcttctcccccttctttcttctttgcgtaaaaggggacatatagagcctctatctgtctctttttacgcaaagataatcgcccgacgcaatggccgcccggcgcgactctgcgcccgtcccgcgctcacgccagtttccgcgtgcgcagcagcatatgcccgcccgccacagtggtcgcgaacaggtacacgtctccgccgtcgcgcagcttgagtttgcgccgcaactgctgcacagtgagcgggaagttccgcacgctcacgttcgccgcggagattccgccaagcacctgcctgacgtcgcgcttgttcatcgtgccgagcgccgtgatctcgaacgcgcgcccgggaaaatctgccaccgggtgctcactcacgaacagatgactgttcgcgccaatctgccgcacatcatagttgcgcgtgatctcgccgaacgcgcccgccttcatgatcgccgcgttcggttcgtacaggtaccgctgcgcgcccagctcgcacgcatccagcacatccgcgcgctgccatgaccccgcggaatccgccccgacctcgaattcaagccgctgcgcatcgttcacgcagacgacccgcacgcgctcatgctcgccgcgcgccagcacgaccacaatctccttgcactcgttccccgtcgcggtgatgtgcacctgcgcaaccgagccgacgaaatccgcaatggtcttgcgccagtcgagcatgggcgagagcttgatcatcacgaacggtgccttgtcgagcagttgtccacgcagtgcgagggcgttcggtgtgcagtcctcgattgcataggtgcgcgcgccatgctcgtcacggcgcgccgggtcaaggtagatcaacgtcgccggcggcatctgcgcaaggtgatccacgccgtctccgcacaccacgtcagcgcgaccgccgagaccaagttcgcgcagattatgccgcgcgacctcgcacagcctctcctgccgctccacataggtgccatgtgcgaatccgcgcaccatggcgctgaaatcgacgccgaatccgccggtgagatcgaccagcgtgggctcgctttcctcctccaccagctgtgccgccacctgtgccttgtattccgcggtgaactgcgacgaacactgttccatcgccagatgcggcggatacacgatgccctcgcacgcggcccactgcggcagtttcgtgcgcgcaatctcgcggccggcaatctggtcgagtgcgaacggcaggtcaagcccgggcacgtcgcgtttcgtgtgcaatgccagttcgcgcacgtcttcgccggcatgcgcgcgtatgaattcgcgtgtttcctgtgacatctgcagattcgccatacccacgagactacccgtgccacacccgttggccatctcatgtgccgcggtcttttcctcgatgtgcgaaatgcgcgccagccacatgccattccgcctgcgacggagtgcgtgacgcggaatcagctgcaagccgacgtatgcgttgcgcggtgcgtaaccgccggcatatatgcacatcgttatccacaattgtgggcaaagtccgcgtttctgacataacatgccgaaattgccttattttgccactatatacgggcataccgtgcagcttgttgcctatttctagattgcccacactccccgctgcccattgtggataacgttgtccacaatattccacagcagaaaccattggaattgcaccgattgtgcataaccatgtggataacttgagcacttatccatacgctatacccatgttatccacaacgttttccacatttgtggaaaactacatgcgtgtaactcaaacacatgttcgaattcatacttccctactccgcagattacggcaccgcaatcgaacacctgtttgcccgccgttgccagaccgcggcgccgcggtacctgtagatccgcgcatgtgcaatggcgcgtcgagcactgcgcagtctcaccccttcttctcacacgacatatttacgtcgattacctaataaaatgccgtgtgaggcaatgttgtctcccgcctcctcaccaatatgagattgcccgtgcaaatacggccctgtagccgagccgcttcattgtcattacgggactcgctttgcaaaggtcacgcggtattgcgcgtatgttgtgccaatctgagaccagattggcacagccgaccagccgcaccgacacccgcgagcgccgaacggcatatcacacggaagactccgtacaatatgccacagattcgcatctgaatggctcaatctgcggaagcatccgaaggatacgccgcgaatgcaccccgcgacggcacatctcacggaaccttccgaacaatctgccggaaagatgccctgaaatggcctgcttcgcggaaccttccgaaagttcgaccgctgaatctacagaaatggcacggcatacggaagcatccgcacaccgtgccatcgcagtgccatgtaaacgcgggtgaggaacgcctcgcgtccgagaccaaggcagaccaaggaacgaggaactagtcgaggaacgggatccagctgccggtacgcatcggattcgcggtattgcaggcgtagcacaccacgagcagcagcaccagcagcaccgcgccatagatcagcgcgcgttccagcaccgggcgacgccgcaatgcgcgcacgccgtcggtcatgagaatcgtgaacaaaccgcctatcacaaagcctcccacatgcgcctgccacgcgatgttcggcacaatgaccggcatgagaaagttgatggccatccacacaatcatcgaagtgaggtcttgcccgaccttgcggtagaccaccagaatcgcggcgaacaggccgaacagcgcacccgaggcgccgtagctcgacgtgaaccacccctcgccggagcggttgagcagcgcccagatcatcatgcccgcatcgccgccgatgcccgagaccatgtacaggatcaggaacgcccaatgccccatcagccgttcgagcaccggccccaccgaccacagcgtgagcatgttgaaaccgatgtgccacagcgacgccggttggtgcaggaacatggcggtgacgagcgtccatggctcgcgggtcatcgaagccggctgcatcatgccgaagcccagcatgccggcaagccctgccggccatacgaaccggaacagggtctccagcagccacacggccacgcatacgagaatgattgcggaggtcaccaccggctcaccgctgcgccatcgtgcgcgcaacgactcagcggagaatatccggcgtgcggacggcgaatcagggaacaaactaaatccacgacgaggcatggctcccactgtactcggccgcgacgcccgcttattctcctgccgaattcgcacagccaggcacactccgtggcaccgactaccgaatcgccatggaactggagtatcattggggacttaagacatcacgcgtcatccgcttgccatgagcacaatatgcgtcatcttgcgatgtggggcttatgatggaaggcagagtcgaccgggccgaaccggacgaccagaatactgaaaggagccgtcatggagaagaagtcttcaaacggttggaagttctttgcactgctgttcggtggtctgcttgcggctgtggttggtctgtacatctacaagcagcagaacccggattacgatccgtgggaggagccgtgggagaacagctcgtcgccggtcgacctgaccctggcacaggacaagaccgaggacgatcttgaccagccggctgcggacgccgcaaaggacgccgcctgagttcacacatgtacggcagggcgccgggtaccgtgttcgagtacccggcgcctttgcatatccgcagaccgccccgtccatcttgcgtaatttcggacacccgcgagcgctatgcgtctctatttacgcaaatgcacaacagatagatacgctcgcgcaatatgctttcggcctccgcctgcatatgcgagcggaggccgaaagcgtcccatcaggaatctgcgaacagattaccgttcatcacttatcgagcgaacgggtgtgccagatgcggtcgaggtagtccttgatcgaacggtcggagctgaagtaaccggagttggcgacgttgagaatcgccttacggttccattcgagctggtcggcatacagtgcgtcgatatcggcctgaatgtcatggtaggcggagaagtcggccagcgtcatgaaccagtccttcgtcagccagtcggagaccagcggggcgtaggtgttcctgtcgccgttcgagaacgtgccgtcggcaaccatgtcgatcgcggccttcagacgcgggtcggcctcatagtacttgctcgggtcgtagccctgctcgtacatcttctccacctcgtcgacggtcatgccgaagaggaagaagttgtcggcgcccacgcgctcgcgaatctccacgttcgcgccgtcgagcgtgcccacggtgagcgcgccgttgagggcgaacttcatgttcgaggtgcccgaggcctccttgccggcctgcgagatctgctcgtcgagctcggtggccgggatgagcatctgcgcgacctcgatgttgtagttccacgggaagaagatcttgatcttgccgttgacatccggatcgttgtcgatcaccttggccacgttgttgatgagctggatcgtcatcttggcgaggtagtagcccggggcggccttcgcaccgaagatgtaggtgcgcggcgtgatgtcctggacgttgaccttgccgctcttgatgtcggagtacgtggcgatgatctcgaggatcttcagtgcctggcgcttgtattcgtgcagacgcttgatcatcgtgtcgaacatcgtgttggcatcgagttcggcgccgtagcgctgcttggagaagtcggcgaatgcgaccttgttctcgtgcttcacggcggcgaacttcttcacgaactcgtcgtcctgggcgagcggcgcgaggccttcgagcagatcgaggtcctcaagccacttgtcggtgccgagaccctcggtgatgagctcggagaggcgcggattggccagcttgatgaagcggcgtggggtcacgccgttggtcacgttcttgaacttcgccgggtagacgtcggagaagtcacgcagcgtgacatccttgagcagctgggagtgcagctcggcgacgccgttcacgttggagccggcgtaggtggcgaggtaggccatgcgcaccaccgggtgctcgtcgtcggtgaggatcagcatgcgcttgatctggtcttcgctggcacccttggcctcgagctcggagacgaactgcttgttgatgcgctcgatgatctcgaggtggcgcggcagcagcttgccaatgagcgatgccggccacacttccagtgcttccggaagcagcgtgtggcaggtatagttgaaggtcttgtgggtgacttcccaggcggtgtcccagtcgtagccgtattcgtcgatcatgatgcgcatgagctccggaatgccgatcaccgggtgggtgtcgttgagctggaacgtgatcttgtcggcgaaggtggtcagatccggcttgtcggtgtccgggtagaacacgcgaatcgcatcgtgaatggaggcgctggcgaagaagtactgctgttcgagacgcagttccttgcccacctcggtggagtcctccgggtagagcaccttggagatatcctcggccttgacctgcggcttcaccgcgtcgaggtactcggacttgttgaacgtgagcaggtcgaactcgtcgtaggagcgggcctgccacagacgcagcgtgttcacgcgacccgaggcgtagccgggcaccatgtagtccaccgggatcgcgcgcacggcccagctcggcttccacacacgcttgccgttctcctcgacgaccttgccgccgaagttgacgcgctgatcgcgctcgtagtcgatgtgcccccacgggtcctcattggacagccagtagtccggacgctcgatctggcgaccctcgtcatcgaattcctggcggaagatgccgtacttgtactggatgccgtagccgaaggcgggaacgccgagcgaggcgagcgaatcgatgaagcaggctgcgagacggccgagaccgccgttgcccaggcccggttcgtattccgcgtcgaccactgcctgcgggtcgaagccgaggccgcgcacggcctcttcgaactgcggggtgaggcccgcgttgagcaatgcgttgcgcagctgcttgcccatcaggaattccgcggacaggtagcccacagccttcgtgtcgccgttgatcatgtcctgctgggtcttcatccaggaatccatgagatgacggcggaccacggttgcagtggcaacatagacatcggccgtcttggcctgttccggggtgaccccctgtgtgtacttgagcgcctgtcgaatttcgtcagcgaattcgttggcggtcagcggggacttaggtgccgttagttcggtcatacgtgactccctttatatgttcctcatcgaacgtgcgcgtcggcgggcattgctgcatccgtttttgcatacgttctcataaaatataccaccgcttgctcctttcacgaaaaacgctctgttttccgcattcgtttcgcgcactgtttactgcggcgaccattgcaaacgttggtatccatataccgcacactactcttctctcgttaccgcgaccacccttgcatctcatggcttacccctcccctccttttggtgtaacagcccctgacgcaaaacaccctttgacgcatccctctttgacgcctcccttggcgtaaaaagagacaaatacgactaccaaatgtcactttttacgcagaacaacagacctccacacttcttctctctccccttttccccttctcctcccctatgactttcaccgtgacgtaaaaagagacgaatacagccgccaggcgtctctttttacgcggagaaaacgagtttttcgcaatcaccatagcgtcttcacaaggattaatgccccatgggtaaacagcccattgttatcgagcgttcgatgcagaatcacagtatggcagcaattcgtaagcaagatatgatgcgcggcatgcaggcatacgacgattggtgcacggcggcgcgcgcagcagccgagaccacgccggccctcgacatcgcaccccggctcgaccgcgccaccatggccatggccgtgcgctactcacttcaccagctggaaatcaaggcacccggcccgggcgtggaggtgcgcgtcgcgccgtacgcggtggtcaagatcctggaaggccccgcctcggatccgcataatctcacacctcccgacgtgatcgagctcgatccgcaggtttggctgcgcgtcgccagcggcatcaccacatggcacgaggagcagaaggccgggcgcatcagcgcggtcggcgagcgcgacgatctgtcgccgctgctgccgctcggctgacgccgtacggatgagcgtcacggcatctctttttgcaatcgtttgcataggacgcctaccatctcaatgcggatcaatgcggacgcgcacatgccgagccctatactcacatctacacacatccgcacccgaacgccgtgaggggcgccgctcatcgcgacgcccctcacgaattcatatgtcaccgaaccggcggatctactcctgctggtctgtgtgtttgaaggtttccggcactggcatcggaatcggcttgtgcggctttggtttgggttgcgcgtgagtctccggcatctctccggtcgtggccttcgccgctgcttcggcggcccacttcgcgtattcgtcgaggtcatccaccgtctcgtcgacgtcctgtgcctcgaattcgtcgttctcgacatcggcaaatggatcgaatgagccggtccccggctcgtgcgcgcccaattccttggcaagctcgtcgtaatccgtgtcagtggtcatatacttgagcttcctggcgatcttctgctgtttggctttctgacgtccgcggcccatgcgaccccctgatacttatttgtttcgattcatcacatatgagagtaccaccacttcagacacattgtgttgtcttctcgaatttctacgatgattctttattacataggccatacagcgcatgcagacgcacgcatacagacgagaagaggctaccggcatgaccgacgacatgaacgcgcaactcaccgcggcgggcaatgaaatgagcgcgagcttcctcgcggcgaagaagcgttccgacgaaacgctcgccaagctcaaggcgaacccgggcaaattcaccatgctcaccggagaccgccccaccggccgtctgcatctcggccacttcttcggctccatccgcgagcgtgtcgccatgcagaatctcggcgtgaacacgaatatcatcatcgccgactaccaggtgatcaccgaccgcgataccaccgagcacatcgacgacaacgtgctcaatctcgtgctggactacatggccgccggcatcgaccccgagaagacgatgatcttcacgcattccgcagtgcccgccgagaatcagctcatgctgccattcctctcgctggtcaccgaagccgagctgcaccgcaacccgacggtgaaatctgagatggaatcctccggccatgcgctcaccggactgctgctcacctacccggttcaccaggcgtgcgacatcctgttctgcaaggcgaacgtggtgccgatcggcaaggataatctgccgcacgtcgaaatcacgcgcacgatcgcgcgccgcttcaacgaacgctatgcgaagaagaacccggtgttccccgagccggccgcgattctgtcggaggcgccggagatccccggactcgacggccgcaagatgagcaaatcgtacggcaattcgatcatgctgggcgcgaccgccgaggagaccgccaagctgatcaagaagagccccaccgattccgagcgcaccatcacgttcgacccggtcaatcgcccgcaggtctccgcgctgctcaccaccgcgggtctggtcaccggccgcgacccgagtgagatcgccgccgagatcggcaatgccggtgccggcgcgctcaagaagtatgtgatcgactcggtgaacgaattcctcgcaccgcaccgtgagcgtcgtgccgagctcgccaaggacatggattccgtgcgcgacattctgcatgacggcaacgcccgcgcgaacgcgattgcgaaccagacgctcgacgaggtgcgcgaggccatgggcatgcgctacgaccgctgagcccaacgccatgccgaggtaagacctcattgcagattgccggaaacgacctgcgggtgtgggagggcccgggaaagatcgaggaacgtaaaggggctcttctcaagttagtgtgtaagggccgtgcttcatcattgcttgtgtgatagagaaattgaatgaggaaacacggcctgaacccgagtttagcgtgttcgacccccaacgtttccttggtttggatgagatgggtcttcgtgtgctctcgtggcggcgtcttggcaggccggacggcccggggttaaggcagatcaggtgcgagccggactcgcacgacgcgcgctggtgcccctcgtgcggcgcgtatgccagggtgcgttcgtcgtggctgcgcacgctggcgcatgtgccctacggcgacgacgcggtgcatctgctggtgcgcgtgcgccgctacgagtgcgtgccgtgctcacgctcgtggagcgatgatcttgaggcggtgggcgccggcaggggcgtgttgagcgtgccggcggtgatgtgggcgctgcggcgcgtgtgcctggactcgatgacggtctcggcgtgcgccaggctgcttcatgtggcatgggcggtggtcgaccgggcggtgcgcgagcggggcatgctgttgctcgagcaggccgaccggttctcctcggtgcgcgcgatcggcgtggacgagcacgtgtggcgccacggcgcgttcggcgaccggtacgtgaccgtgatcgtcgacctgaccccgcgttgcgacggcaggccggcaagactgctggacatggtgccgggccgttccgcccaggtgcttcgcgaatggatgcaggcgcgcggcggcgagttcacaagacgcgtcggggtggtcgccatggacgcgttcgccggctggaagcaggccgtcgaatccgtcgtgccccacgcggtcgaggtcatcgacccgttccacgtcgtgcaactggccgccgcccgcgtcaccaaggtgcgctgccgcctgcaacgcgacgccaccggcaggcgcggtgtcaagggcgacaggctctacgactgcaggcgcgccctgctgaccagcgacgaatacctcggcgcacgcggccgtgccagactcatggccctgttcgccatccaggccaaccgcgacctcatgctcgcccacgacgcctaccaaagggtcatacacgcctaccggtgcgacgacaggcgacgcggcgaacgcatgatgcgcgagctgatcgacgacctgaccggaccggggcgctacaaaggctgccgggaactcgcctccctcggccgcgtgctcaaaagacgcatgcgcgacatcctcgccctcttccgccacccccgctcaagcaacggacccaccgaagccatcaacggcaggctcgagaccctgcgcggcaacgccatgggcttcgccaacaccaccagctacatccaacgatgcctcatccacagcagccaactcaaagacatccttacacactaacctgagaagagcccgtaaagggcgcttgcgatccagtgacgaggtctttcccggccctcccacacccgccatacggagggcagacgagaatcacacgtcgtagcgccaggatttgtcggtgatcacgcgcgccatcgcaagaccgataggcaggcagatgatcaccatgaacgcacggaacgcccagtccagagcgagcagtgtgttgaactggccgagatagaacatcgcgcggtacatatacaggccgggcaccatgatcacaatcgacggcaccgtcaggcagatgcgcgggtaacccagatgcggtgcgagcagaccgtgccgcactgcggaacgccaagcggaggcgatgagaccggcaagcagggcgccaatgaaggcaccggcttcggcgggaacaccccaatccacgatctccaagcgcagggtgtcggtgatcatgccgatcgtggcggccaccaggcacatgcgctgcggtgaattgaacagcacagagaagccccacacgccaacgaacgcgaacagtgcgcgcagggcaccagtggcccacggattcaacggcggcgtgtcgaagccttgcgggttcaggtgcacgagcacggcgaccatccagcccgcgagcgtggccatcaatatgatgcagcacacgtaggcgatgcgttgcaccccggaggggaagtctatcttcgccatgtcaaggccgccggtgatgagtgggaagccggggatcacgaacagcatggcgccgatgtaggcggtgtcgtggtggagcgcgaccgggtcgaatatgccgatgagccgcagcgtgcccacgcaggcgagcgccgccaccgccaccgccacgaaggtgacgaagaactggttcaggtggtgcgcgaacagtctgcgtcgcgcccattggccgagtccggcaccgatgaacgcgccgatcatgtcgtagggcgcaccgccgagcaggaacacgaaggccgcgcaggcgcaggcggcggcgaatccggagaaggccgacgaatagagcggcttgcggcgttcgatcaagtcgaggcgcttgtgcacctggcccaccgtgatcggcccggattcgcgcacgcgcttctcggcatgttcttcgagatggtcgaaatgctcggcgtattcgtcttcgggcaacttcttcttcgcgcgttcggcaacccgctcggcgacccgtgagcgcaggctcgcccgtttcgccgcgagtttttgcgcgcgtgcctcctgcctgagccgttctcgcagctgtttcgccgtctccgcggagatctgcgaggcgtcgcgcgtgcccagcgtgttcggctgcatgagctggcgtgagacctcggtgcgacggtggtacatggtgcccgcgccgagattgacgctgaaccagtccgcaaaatgctcgagcagccagatccgctcggtgttcacgccggtcgtcggcagattcacgacttcggtgatgcgttccttgccgtcggtgcaggaggcctggacgtcggtcagattgacgtccgcgcgcacatgcacgccgagcgggtaggcgatgcggtgcatcatctcgcgcacacggaagcttccggtgcccgcgccgaggtcgagcatgcccacgcgtacgatcacactggccttggcggcgatgcccgcgtcggtgatcggcttgtcccagtcgcgctcgatgtcttccatgtcgagcgggatcgcgtgcgaatggaatctgcgcaccgccccggccgccgacttcacgggccgggaacgccagtgcacgcgtgcgctgtgccggtcatgaccatgcatgtcgtcggtggtggttgcagattcttcttcgctcttgctcacatctctacttctactacccccgcgcgaacattcgcgatggccgccgccaaagacgcaatctcacactccgaccgcccctgcccaaacgtaacaaacgtgtctcatgctcgtacttacaatacaaacgcaactttactgaacacgggctgtgggctcgcaacgatcggcgccaagaactgcggaggagccgcagaagaccgatagaccgagcaacccaatgtttggagaaagaggtcgaatgactgatcaagagcaaacgatcacgccggccgacgccacgatcgtgtcgtccgggctcggcaccaaaggtcccgaagagcgcacgcttcccgcgacattgcaggaagacatggacttgtgtctgaacattctgcgccaggtgctttccgaatacgacgagaatcttctcaaaacgtttgacaccgtgcgtcagtatgccgtcgatgccagtgccgagcggttctccggcgtgctcaccgacacgcatcccgaacgagacgacctagagatggccgtcaagacgatcgatgcgatgaatctgcacgatgctcagctgctcgcccgcgcgttcgccacgtacttccacctggcgaatctgtgcgaggagaactaccgtgtggccgtgctccatgagcgcgaggccaaggtcgacgacacccaggccatcgatccggtgaacgagatgacgaaggcctaccaccagctcatctccgaaatgggtccggccaaggccaaggagctgctcgaacgcctcgaattccacccggtgttcactgcacaccccaccgaggcgcgccgcaaggccgtggaaggcaagatccgccgcatcgcacagctgctcgaagcgcaccgtctgctcggcggctccgacaagaaggaggacagccgtcgcctgtacagcgagatcgacgcactgttccgcacgtcgccgattgcgctgaagaagccgacgcctgtcgaagaggccgacacgattctcgacatcttcgacaacacgctgttccacacgattccgatggtctaccgtcgtttcgacgactggatgctcggcgacaaggcaggcatcgagccgccggcatgccccgcgttcttccacccgggcagctggatcggttccgaccgcgacggcaacccgaacgtcaccgccaaggtgagccgtcaggtggcccgcaagttcagcgaccatgtgctcgccgcgctcgaggaggccacgcgcaccgtcggccgcaacatgaccgtcgaatccgagaccacgccaccgagcgacgaactgcgcgcgctgtggaaccagcagaaggagatcagcgagcgactcaccggcaaggcatcgctcatctccacgaaggagctgcatcgcgcggtgctgctcgtcatggccgaccgcctgcattacacgatcaagcgcgacaccgatctcatgtaccacaactgcgacgacttcctcgcggatcttcgcgtggtgcagcgttcgctcgccgaggccggcgacaaacgcgccgcctatggcccgctgcaggacctcatctggcagaccgagaccttcggcttccacatggtcgaaatggagttccgccagcattcggtggtgcatgcgcgcgccctcgacgacattcgcgagcacggcctgcatggcgaacgcggaccgttgcagccgatgacgcatgaggtgctcgacaccttccgtgccctcggcgcgatccagaagcgcaatggcgtcaaggccgcgcgccgctacatcatctcgttcacgaagagcgcgaagaacgtgcgcgacgtgtacgagctcaaccgtctggcgttctcgaatccggacgacgccccggtgatcgacgtgatcccgctgttcgaacagctcgaggatctcgagcattcggtctcggtgctcgacgagatgctgaagattcccgaggtgcaggcccgactcaagcagaccggccgcaagatggaggtcatgctcggctactcggattcgtcgaaggatgccggccccaccaccgccacgctcgcgctgcactccgcgcaggagcgcattgcgaagtgggcggacgagaacgacatcgatctgacgctgttccacggccgcggcggcgccgtcggtcgtggcggtggcccggccaaccgcgcggtgctcgcacagccgaagggttcggtcaagtgccgcttcaagctcaccgagcagggcgaggtcatcttcgcccgctacggcaatccggtactcgccatccgacacgtcgagtccgtggccgccgcgacgctgttgcagtcggctccgagcgtggagaagacgaacaccgagatgaccgagaagtacaagccaatggcgaatcagctcagcgaagtttcacatgaaacgttccttgatctgctcaacagcgaggacttcgcgccatggttctcgatcgtcacgccgttgaccgagatcggcttgctgccgatcggttcccgccctgcgaagcgcggcttgggagccaagtcgctcgacgatctgcgtacgatcccgtggatcttctcgtgggcccaggcccgcatcaacctcgccgcctggtatggcctcggctccgcatgcgagtcgttcggcgacctcgccacgctgcgcaaggcatacgaggaatggccgctgttctccacgttcatcgacaacatcgagatgtcgctggcgaagaccgacgaacgcatcgcgaagatgtaccttgcactcggcgaccgcccggacctctcgaagaaggtgctcgacgagatggaactcacacgcaagtgggtgctcaagatcgtcggcgacgaatggccgctgcagcaccgtcatgtgcttggccaggcgattcgcatccgctccccgtacgtcgacgcactgtccgtcacgcaggtgctcgcattgcgttcgctgcgtaagaaggtcgacaaggaggagctctccgaaagccagcaggcaggattcatctacctgatcctctgcaccgtttcgggtgtcgccgccggcctgcagaacaccggctgattccaccgatcgacaagcatggcagagccccgtattcccacaggattgcggggctctcctgttccgcacaagcgcctcgaccaccgccccacaatcctcacgccttgtgcctcgcgcctcgcgctttgtacgtaattcaggacaaatcgccgtcgattatgccccattttacgtaggaatcagatgattacgtaaaaagagacagttcgatagcgaaatctgtctctttttacgcagatatcaggcgtacgtgaacgtcatcgggtcgtgcccggcgcgcgtggggccgtcgagagcgtcgatctcggcatgctcctgcggagtcaacgagaagccgaacagatcgagattctcacgctggcgctcggtatgcacggacttggggatgatgatcgtgccgttctcgatatgccaacgcaaaatcacctgcgcaggggtcacaccatgcgcctccgcgatccgctcgatcaccccgttcgccaggtcggcgccgcgtgccatcggcgaatacgcctccaccgcgatatcgtgcgcatggcagtattccaccacatcgcgctgctgccacgtgggatgcagttcaatctgattgaccgtcgggtattcacccgtctcctcatacaacctgtcgaggtgctcgggcatgaaattgcagacgccgagcgtacgtacacggccgtcttcacgtagtttcgcgaacgctttccatgtctcgccgctgcgccaatcgaacggcgtgggccagtggatcatgtacatgtccacatagtccaactgcagcaattcgagcgagcggtcgaacgcgtgcatcgcggaatcgtagccctgctcggaatcacgcagtttcgtcgtcatccacagactctcgcgctgttcgccggtgttgtaaccggtcgcggcgagcgcacgtcccacgccctcctcgttgttgtagccggcagcgccgtcgatatgccgatagccgattgcgagcgccgattcaacgaccggcacgacgccctcatcgtcgatgcgcagcacgccgaggcctatctgcggaatcctgctgccgtcgtgcagagtgatgagggggatatctggagtctggtcagcgagcgtgctcatatgcgcctttctgtggttctacggccgatgttagcactgaggccccgcatcagcatgcggggcgcggaaatgccgtgcgccggaacgcaacaggtaccggcgcacggcagggaaggaacgtgggaatcgggcaatcagtggcgattggcaagctcgtggaacacgtcctcaatctcgagttcgcgttcgaattcgcgcggtgtggtctcggcgtcgatcgccgcgagttcgacgccggcgatgcgcgcgaagtcctcccatgcctcacgaccgaccgaggtggtcatgcacgtatggtgggagccgcctgcacgcagccagcattcggcggaaatctccagattcggctccggcttccacagcgcacgggcgcatggcagcttgtcgagcgagccgagcggttcgaccacatcgaccacattcatgagcatacggaaccgagtacggacgtcggcgagcgagaccacaaccgcatccttcttcggagccacagtgaacaccaggcgaaccggatcggccttgccgccgatgccgagcggatggatctcgagacgcggcttggcgattgtgcccaccgacggcgagacctcaagcatgtgcgaccccatgatcatctcgttgcccggggtgaagttataggagtagtcctccatgagcgacgcaccaccctcgagaccatagcccatcacggccccgatacgcacgagcactgccgtcttccagtcgccctcggccgagaatccccagccgtattcggacgggaagcgctgcggacccacgcccggcagctgcggcagggcgccgaggtcctcgaagttgtcgacgccagccgtgcagccattggcgcgcatcatgttcaccattgcgcattcctcacgagcggcgatgaacagcgaatcatagtccttgtccagcagctcgggcgcgatctcgtacttcgccttgtagtcctcgatgaggtccttgatctggttctccttgaccgcatcgtacgcggcgacgagctcgttgacggcccaggtgttgatcgaggcgccgaatacacgctccgcctcggtcttgtcgccttcggtgacggcaacgttgcgcatattgtcgccccagcgcatcacgttcatcgtgttcgaggcctgccaaccggcgcaggcgcgcgcccacacgccgatcttgtcggccaccgcgggatcggtgtaatgccccacgacgatcttgcgcgggatgccgagacgagtgacaatgtagccgtattcacgatcgccgtgcgcggcctggttgagattcatgaaatccatgtcaatggtctcccatggaatctcgaaatggtgttgggtgttaagctgcagcaatggcttgcgcagcgcctcgagcccacggatccacatcttcgccggcgagaaggtgtgcatccacgtgatcacgccgatgcatgaatcatcggccgaggcgtccaccatgaagcgacgcacgccgtcagacgacttcagcgtgggcttgagcacgagcttgacggggatgcggccactcgcgttgagcgagtcgacaatctcggcggactgttgcgccacctgtcgcagtgcctcctcgccgtacaggtcctgcgagcccacgccgaaccagatctccttgccttcgaacggattttccattgccatgttgttttcctcacttcattgtggattgttggaattgattatgaaccgatgtggattgatgtatggatgactcagccatttgcccgcccttgcgtaatccgggacgaataaccgcagtttctgtccctttctacgcaaaccgacttgctaccttgccgccttgccgccttgctaccttgcgtaattcgagacaaaaaccatgcgaatctgtctcttcttacgcagttgaatttgtgtatgcagttgtattgtgatggtgcaagtcagtgctggccatacacattctggtagcggtcattgagtttatcgatgtcttcctgaggaatcggaatgatgtcgccgagctgcttggccgcccacatcgtatgcgccacctcctcggtcatcgcggcggccttgaccgcggcctctgcatctttgccgatggtgaatgggccgtgattctgcatgagcacggccggtgatttcgggtacgccttgagggtctcgaccacaccttcgccaatggcctccgaaccgatcagacggaacggccccaccggcaccggaccaccgaactcgtcgcccatcatcgtcaatccgcatggaatattctgcccggtggcggcccatgcggtcgcataggtggaatgggtatgcaccacgccatacacctccggcatgtggcggtagatgtatgcatgtgaagcagtgtccgacgatggtgattccgcaccgtcgacgacgttgccgtcgaggtcgcacacgaccatcgagctcggtgtcagatattcgtaacgcagccctgatggtttgattaccatgaggtcagctgtgcgcagacgctgcgaaacgttccctgccgtccagaccaccagattccacttgatgagctgttcgtgcagtgcggcgaccacctcccgcacctgcttgacctccgcacggacttccggtccataatccgccagtgttgccattgttgttcctttctgtacagtttcagatacttgcgcagatccgtacgctgcagattcacccaccgatttcgacgtgctcaacggcactgcgctccaccggcaacgccttgacgaatctggcgaagaatcgctggaatccatccacatcgtccggccggggagcttcggtcaccgattccgccccggcgaacacgacatcgtccaaataatctgcaagcgtgagatcggcgtgacgcaaatagtccgcaagcacggccatgccccacgctcccccttcggacgcggtggtcatcacacggatcggcgtattgaacgccgccgcgagaatgcgttgcgccaccacaggcgtggcgaagatgccaccatggcccaccagcgagtcaatctcgacgccctcgtcctcggtcatcacgttcataccaatggtcaccggcgagaatgcgccaaacagctgtgcccgcatgaagttggcgagcgagaatcgcgcctcgggcccgcgcacgaacagcggacgcccctcggcgagcccggcgagaaattcgccggtacggaatgggtaggcgagcagaccaccggcatctggatccgcatcctcgcctatggccgcgcggaacagctcgccgtacagggtgccgtcatcgacgtttcgtccgttgagctgtgagaactggcggaacaggtccacccatccattgagatcggcggtgaagttgttcgcatggctcataccggccagatcgcccgcgggggtggtcaccaagtccacttcggggcgcaacttggagagtttgtgctcaagcacaacggtggcgaagatcgaggttcccgcagacacgttgccggtacgacggcgtaccgagttcgtggccaccatgccggttccggcatcaccttccggaggagcgagcatcgttcccggctgaagtacgccagacgggtcgagcagcgccgcgccttccggcgtgagttcgccggccggggtgcccgcaacaagcggttcgggaagcaaatcgttgagcttccacggttgtgcggcgacttcaggcagcgcatcgaactgttcaatgaatccctgctcataggtcttggtgttcggatcaatcgggaacattccggacgcatcaccgatgcccagcaccttgcgaccggtgagcttccagtgtacatagccggaaagcgtggtgaaatagcgcacggaaccgatatgcggctcattgtcgagcaccgcctgatacaggtgcgcgattgaccaacgttccggaatgttgtattggaaaagctcggagagtttctcatgagcctcgctcgtgttggtgttctgccaggtccggaacggcacgagcagttcaccatccgcatcgaaagcgagatacccatgcatcatcgcggagaagccaatctggccgatgcgcgtgagcttgaggccgtaatcggcctccacgcggtcggccacatcggcatagacactctgcagtccgcgccagatcttgtccacgtcatacgaccacaggccgtccacaagatgtgactgccaaccataatcaccggtggtgatcgtattgcgctcatcgtcgatgagcaccgccttgatgcgcgtggaaccgaattcaatccccaacgacgtgcgcccgtcacgaatggcctgtgcaatcgccttcgaatctgccatggttcctcctgcttcgggattcagttccgcaatgaactcatgcgtcatgtatatgttagcgctcacacaaacagaacacgccgaacaggggcatacccctgggcatagatcacgtccaccaacccgacacgccgagcaaatggctgaatatcaagtgttatctaacctttgagcatttcccgccgcgcaagcatcttgtgagcggtaacatgaagtacaaggttgtactagctcaaccacactcaatcccatctcttcgacgacgaagagacgtcgcagagaagaacaacgttgcattcagtgcagcagagaggaaaacataccatgccgcagcatagcgaagcacaagccagactggtggtggatgacgaattcagggtcggcccggtacacgaccgtgtattcggttcgttcgtcgaacatctggggcgttgcgtgtacaccggcatctatgaaccggggcatcccactgccgatgccgaggggttccgccaagacgtcatcgatctggtcaaggaactcggtgccaccaccatccgctatcccggcggcaactttgtgtcaggctatcaatgggaggatggcattggcccaaaggagaaccgacctcgtcgccttgatctggcttggcattccaccgaaacgaatcagttcgggctgcacgaaatggtctcatggctgaataaggccggcggcaacgagttgatggaagccgtcaatctcggcacccgcggattgccagaagcactggatctgcttgaatatgcgaacgttccggaaggcactgcccgctcggaggaacgtattcgcaacggcgccgataacccgttcgacatccgcatgtggtgcttgggcaatgaaatggacggcccttggcagctcgggcacaaggacgccgaggcctacggcaagctcgcggcctcggtggcggcaggcatgcgcatgttagaccccgatcttgagctggtcgtctgtggttcatcgaaccatacgatggactctttcggcaaatgggaggagaccgtgctcgagcacaccttcgacaaggtggatttcgtttcagcacatgcctactatttcccgcagctgatggagaacggctcgcgcgacatggcgtcgttcctcgcctccggcgtggatatggatggattcatcaaagatgtgggcgccgccatcgacgccacgaaggcgcgactcaagagcgaccacaacgtgtacatttccttcgatgagtggaatgtgtggtactacgaggaggaacccagcaagaacccggaaggcataggcaactggcccgtggcccctcggctgctcgaggacgtctacaccgtggccgatgccgtggtggtgggtgacctcctcatcacattgctgcaaaacgcagatcgtgtgcatgcggcatcactcgctcagctcgtcaacgtcatcgcccccatcatgaccgagccgaatgggcccgcttggcgccaaaccaccttctacccgttctccctcaccgcagcctgggccaagggcggcgatgtgctggagcccaagatcgagtccacccagtaccacaccaaccgctatggcaacgtgaactccacgaatgccgtggccgtgcgaggcaaagacggctcggtctccgtgtttgtcaccaaccgttcgctggacgatggatgcgacttcgagatcaagttgccggaaggtttcacacctaccgagcttgatgtgagaacgttgcacgatgacgacatgctggccacaaacaccgtgaaccatcaggatcgcgtggtgccccaccccaacgacaccgcctccatccaggatggcatggtcaccgtgacccttccgccggtgagttggaccgcaatccatctgcgctgacacaacggcccggaccgtcggtctgggccaccggcatccccggcaacgtgcatagtgatgcgattcaaggcgataggcaatgcataggtaaacagcaaggcgcatcggagaccgaccatggcaaaaggcgtgaccatcaaggatgtcgcggccgaggccggcgtatcgttcaaaacagtctcgaacgtgatcaacggcaccggcagcatgcgtgaatcgacacgtggacgcgtgcttgaggcaatggacaagctgaactacacgatcaacctgtcggcacgttcactgaaaaccggcacaaccgggttgctcggattggccatcttcgatttctcccagccattcgcctcgtatctggccgatcagatcatcgtctgcgcgcgggagcatcattacggggtcatcataaacacctacggccagaatgagcacggcctggcacgggcgatgcggcaggcgaacaatctggccgcagacgggtggatcgtcttcgccgatcatgcaatgggacaacacagcaagatgctcgaccaaagctatcctctggtgctcaccggcgactgggacgcctatggcaaggtggatcaggtcaccatgccgaacgtggaggcgatgcgatacaccaccaatcgcctgcttgattccgggtaccgttccatcgcgctgttcggcgcagacggctcgctcggcgcaagacattaccgacaagccaccgagggtacgcaggaactccgcgtgcaagggtatatgcaggcatacgaggagcatggcatcgaggcccgcatggacatgctgttctcaggtggcttattgacgagcgacagcggcgttcgcgcaacgaatctgatgatggaccaaggcgtgcgaccggacgccatcatctgtctcaatgacgcgatggcgctgggagcgttgcatcaattgcaggtacggggaatccgggtgcccgacgatgtgcaggtggtgggtttcgacaatgtaccggaggcgacgtatgcgaacccttccctgacgacaatcgacccgcatatcgacagctatgcgcggcacgcggtggacatgctcatcgaacgcattcaagggtacgatggcgcgaaacgcgtatacacatccgatttcaccttggtggagcgctcgtcaaccagtctatgaccggcgcttctttgacgtgcccttgcgcaacggcgactgccgttcggccggatgcagctcggggaaacgcgccagcaagcctcgccgaaccaccggaatgcgactcaccgccacacccactgcgagagccgcgattgcgagccacgatgccagatcatagccgagcagcatcagcacgatcacaatgccgcaggcgagcacaccgccgagctgctggtatttcatatgccattccgtcaactcgtcccgtttgaacggcaatgaccccagaaacacgcccatgcccagacatgcgaccgccgtcaccacggtgactacgatttccgctgcacccatgccattcccttccttacctttgtcttacttctgtcgtttcttacatttcttctcaccctgcgcaaaaggtgacaaaaccttccacctgcgtaaaacgggacaaaaacccatcagaacccgtcccaaattacgcaaattggacgcagcccgacacacgctgcaacttaggcagcgcagatgggaaccacatgacagctcgttcatgccatggttccatcgcgatccccaccgcgagacgggcgcggatgcgactcgcgggcaatcggcatgcgcgcacgcgacgcccgttcgcacggccgagacggcgtcgtaccggatccgcccacgccggcgatctccgcgatgtcctcttcgtaggaggtctccgacgtgttgtgcacggcgcgaatctcacccagccgcatcacgacgatgcgatcggcgaccgcgaacacattcggcagatcatggcagaccatgatgacgctgcggtcgtccgatctcaaccgcacgatgtagtcaagcacctcggccgtctgcgtcaccgacagcgacgccgtgggctcgtcaagcacgatgaggctcggatcgttgagcagcgtgcgcgcgatggcgatggtctggcgctgtcctcccgaaagcgacgcgatgctctggccggcgcgcacggacgtcgacagcgtgttaagcacctcgcgcgccttgttgtacatgccctcatcgtcgcggctggcaaatccctgccgcatctccctgccgaggaagatgttcgccgatacatccagattctcgcagaactgaggttgctggaaggccggcgctatgcccaggtcgatggccttcgccacgccgtcgagccgcaccgtctccccgcccaccgcgatgctgccggcatccggctgctccagaccggccagcacatgcaccagcgtggatttgccggcgccgttgtcggcgcactggtcatgggcgtcatcaaccagggcctgtcgatcatgggcgtcgacaccgcagtggtgaagacgatcaagggtcttgtgctcctgggcgccgtggcggtggacatcctctccaagcgcaagaagagctagcgattgcaagccggttggacggcagcatgccatccaaccggccacctacacttcccttcccctctcggaatgggtcgccggcgatcccattcaccggcggccatcctctcttcgccaacacatctgctccccactcgaatctcactcggaggaacgcatgaacatcaattccaccgcacgagcccgcctctacgccctcaccgccgtggcctgcgccatctggctcttccagaactgcgtggaggccaatgccagtggagatctcctcagctggtcgaacatcatcctcagcatctgcctcatcatcgtcaccgggtactgcgcagtcaatgcggtgctcggctggaacacgaaatccgcagacaccgaagacccctccaagtagacccccatcgcgcacgcggagcggcacggcgagcgacgcattcgcaccactctcacctgcgcggcgccgcacgcacggactgccgcacaatcaggtccgccgacaccagtcccacgccatgctgtgagttcgggtaacccggctcggcctcctcccccatgaggaacagcgcctccttcatggccatcgtgcccaggtcgtcgaaatcctgcctcaccgtggtcagcggcgggtacagattgctcatgccgggcatgtcgtcgaagccggtcacgctcatatcgtcgggcacacgcacgccatgctcgagcaatgcgcggatcacaccgatcgccatgacgtcgttcgagcataccgcgcaagtgggcaggcggccgccgttcgaaccgatgttgtcgagaatatggttcatacgccggtaggcgtcggcggattcccaatcatcgccgcactgcaccgtcaccgaattcacggtgttctgcgcacacagcttgttccatgccatcaggcgcgtgctggcgtcgcgccactgccccggccccgcgaagaacagcacgttgcggtgcccgtgcttgcgtatgagtcgcatcaccgacgccatgccggcccactggtctatgcccaccaacgaaacacgcctgcgctggcgtgcgttgaacatgtgcaagccctcgctcacactcacaccgccgtgcgacgaggtgatgatcacgcacggctggctcacttgcgacttgcaggccaccttgaacatctcgtcggtgggcgtcaggaagatgaacgcgtcgacgccctgctgcatgaacatgccgcacaaatcgtcgaattcctgctgtgtgcactcggcctcatgcaccatggccaccgaaacgaacataccatgagcgcgggcagtcgcctcaatggacgccaatgcgctcaccgggccgtagaaacgctggccaccggcgatcatgccaaccgtgcgcgtgcggttcgacgccagtgagcgcgcggaattgctggggtgatagccgagttcggcaatggcatgctccaccttcgcgcgagtcgcctccgccacgttgggggaatggttgatcacgcgtgacacggtctggtggctcacgccggcgagtttcgccacctcgaaaatggagggccgcttcgctcccctatgccccgccatcgccacctccgctcgcgaacacatcaccaactgtattcaagagattctatgatgtaccgtaacccagcggacatcgaggcgataaggggaatcatgaccgacagcactcaggaaaccaccgcaaacagcacatggagccgtatgctcgccggcaaccgacgcttcgccgaaggcaacgcggagcacccgtggcgagacaaggagacacgtgagtcgctcatcgacacgcagaaccccgatgccgccgtgctgagctgctcggattcgcgcgtgcctcccgagatcatcttcgatgcgggtctcggtgacatgttcacggtgcgcaccgccggcgagatgctcgaccaggccgtgctgcagacgctcgaatatgcggtctcgtcgctgcacgtgagtctgctcgtcgtgctctctcaccagcattgcgccgcagtcgcgcaggcggagaaggaactcgatgcactcaccgagcacctcacccacgaaatcaccgacgcgcaggagagggaacggatcatggaggatctcgacgaggtgatcgcatcatcgtcgagcgaattcctgaagaacataggcatctccgtatggcaggcccgcatggccggccttgattcgcgtgacgactacgagcaggtgcacattgcgcacacaatcgagcaactcgtcacgagttccgagatgattcgcgacgcgctcgcccacgaacggctcatgattgtgggagcccgctaccgtctcgacacgggcctggtggaggtgctgagcttctgactcactgaaaagggaataagctgatggaagcctgccattgccgcgccagcctacgtatcttcgattgttaggtgggcgcctagagcaacatacgcaacccagccccttttattagacaaccattcgagcatttgtttgataaaaaggctttttgcagtcgatacgctaaagagccccacctaacaatcgaaaatagcggctgccgtaccagaatgcgtcattcgctcgtaatctcttcacattggcgaacacattggcgtgccaatgacatacgcttgaggctatgtcacttggtttgaacattctgctcattttcgtcttcctgctgcttggttccgtgttcgccggcaccgagctcgcgctcgtctcgctgcgcggttcgcagatcgaccagatggaacaggaggacgcccgaggcaagcgcgtggcgaagatcgcccgtgacccgaacacgttcctgtccaccgtgcagatcggcgtcacgctctccggcttcctctccgcctccttcggcgaatcgtcgatctcgccgttcatcgtaccggtggtggaaggctggggcgtgccaagcaatgtggccgcaccgctcacaaccattgtgctcacgctcgtcatttcatactgctcgattgtgatctccgagatggtgccgaagcgcatcgccatgcagcgcaatgaacagatcgcccgcgccgtcgtgccggcgatcagcgcatttgcgaaggtgtgccggccgatcatctggctcattggcaagaacacgaatggcattgtgcgactactcggcttcgacccgaacgagacggagtccgaggtctcggacgaggagctgcgcgtgctggtgagctcgaacacgaatcttaccaaagacgaacgcacgattctcgacgacgtgttcgacgcctcggagaccattgtcgccgaggtcatgcgcccgcgtgccgacgtggtcttcctcgacggcgacaccccgctggcggacgccgcggcccaggtgcgcgagctgccgtactcgcgttacccggtgattggcaaatcgttcgacgacgtactcggattcgtgcatgtgcgcgacctgctcgacgttcgcgacccgaatgcgaagacggtggccgatgtcacgcgcgagggcatttcactgccgggcacgtcgaaactgctaccgagcttgtcgctgctgcgcaaacgcggcattcatctggctgtggtgattgatgaatacggcggcaccgacggcattgtcacgcttgaagacatgaccgaggagctcgtcggcgacattcgcgacgagtatgacctgccggaggacaccccgaaagacaagctgcccaccgacgtgttcgtggacggcgtcgccaccatcgacggcggcatgaccatcgaggatttcgccgatctcaccggcatcgaactcgaggacggcccgtatgagacggtcgccggctacttcctcgcgcattccggcaagatgggcgaggtgggtgaccacctcgtggtggatgacgcgtatacgatgacgatcacgaaggtggacggccgccgcatcgagacgatcgaggtgcgcaagggcacggcgaacggcggcacggaggtctcagacgaccagcaggccaacgacccggagcattccgacaagtagacagccgtcgtgagagctaggtcacattaggctatcagctcatgctcatgtgttgccgggttcacgtacgtaagctcgaataagagcctgcagaacgtaggcgatttcgtgaaaggacgtgcatatggcattgtcattcattattccaggcctcgacgaggtggcttcggagaagatcatcggcattctccaggagcgtctgagccaggagcaggaagcagcgcttgtgctcaagcatgcgcattggaatgtggccggccccaacttcatcgccgtgcacgagatgctcgacccgcaggtcgacgaggtgctcgcgatggccgacgagacggctgagcgcatcgccgcactgggcggctcgccaagcggccgtccggacgacatcgtgcgctaccgcacgtgggacaagttcgagcttgaggggcgccagaacacactcgactacctgcgcgcgctcgacaagtactacgattcgttcatcaaggccgaccgcaccgcgatcaaggagctcgacgacctcgatgtgatcagctcgaacatcgtgcaggatcacgtgctcaagcttgagcagttccagtggttcatgcgctcgttcctcatcgactgagcgcttcgtccccatgcaatgtggcctccactcattcgtgagtggaggccacattcattattcattgcggcatattcatcccgcgaaaatcgacggcgaacagacccattcggcatagacaggggaactgccttataatcacgtaggaaaccatgcagccttccgtggaggaatccgtgaacacacgcacacgcaaatccccgcaacagcgtgaggaggagattctccgcgccaccgtcaaactcatctcccaacggggctacaacggcatctccctgcgagatgtcgcatccgaagtgggaatgacccagcagggcgtactgcattacgtgggcaacaaggccggattggctgcgatggtgatgaaggagttctacgaccccacaagcatgccaggggacttccttgcgagcgggctgccaggcagcgaccgggatgcgccgcacttccccgcctacttgcgctatgtggtgagagagaacgccaagcgccgcgatctggtgcagatgttcgccattctgcaggccgagtccattgacccggatcacccggcccacgactatttcgagcacagacctgcaatcatctggcagacgctcagcaactaccaatggaaacttccaccgcagatcggcacttgggagaacttcaagccactgcaccgcatggccctcgaagcaatggacggcatccaattgcgatggctgcgttccgacccgattgacctgtacgacgaatggatcgccttcgaacgcatactgttcccctcgcccgtttgggacaactaccggtaagtaccgatcgggccatgcggcatacgcgtatcatcacaccacatggctcgacccctaccgcacgcttttgatcagcatgatgaagagtgacgcgaatgcggcgaatccaatggccaccgggaagaccaccgtataaccgccggtcgcggccacaacggccgaagtgacgatcggcccgaccatctgccccagcgtcgttgcgatgttgagaatgcccagatccttccccgcctcctctttgttgggaagcacatcgacgttcagagcttggtcgacggcaccatacaggccataaccgaatccggagaaccctgcgaacaggatcatggacaacgggctgtgcagaatccaaggcagcacaaaaccaaccgccatcagcacactcgcaagaacgatcatgatcttgcgtttgccgatcctgtcggaaatggggccaccggcaagcgaggacaccaggcccacaatcatcgagaccatcgacatcacggcgattgtgttacccgcctgctgcgctgactgtccgacgtaatcctcaagcacatacagttggtaattgagtatcatgtagtacgcgaagatgaacagggaacgccccacgaacgccagccagaaatcacgggcgcctttggtgggggggatgaaggatttgagcatatccccgaaaccgttggacgtctttgccagatgcttcgaactcggctcctttggccagaccagcaccgtgcagattcctgccagccccatcagagtgccgctgagcaggaatccggggatctgattggagaggaacctcgaccccagcatctgcccgagagcgctgcccaccgcggtaccaccggcaaggaacgcagacatcgtgccacgcatattggccggcactcggtcggacagggtcgcaatgaccggcgcgatcatcatgttcaggccaatcatgcatacgcagtagctgatgccgatcagccatacattgtcaaggaaaccgaccagtgcaagcgatacgccgccgacaatgccgccagaaatgacccagggggtgcgccggccgaatctcgagcgagtgtggtccgacaaattgcccacaacgagattggacagcagcgagatgaacgccgtgcatgcattgatgacgccgaatgcagcagtcgccgcatccgctcccatcacgtcgcgcaagcgctgaggcaacaggacggccgcgaccatgaacaagcccgagcaccacaacaggggaaacaccaggaacgatgcgagcagacgtattctatcgctccgactgagcgcagacgacgtttgctccaatgaaacagttgacatctctatctcctttgatagtagaaccaaactggaactggaagggttgcgtaaaacacatttaactaccacctaatagttaaatgtgtttcacaatatacaccgagccaaagaagctgcgaaatcagttaagttgtctatacaacgcagatggattcatcatttgcggaggaagatgagacccggtacgatacttcttatatctaccataaagtagataatctggacatatacgacgcttgcggtaggggcaatgccgccccaccgttcaccttgcacaacacatagcggaaccaaggagagacacatggcccgcgcatacaccgaccccattctgttcggcgcagcatactatgatgaatacatcccgcgcgatctggatcgcattgacaccgacatggagatgatgacccgagcgggcatcaacgtcattcgcatcggcgaatccacgtggtccacatgcgaaccccagcccgggcatttcgactggacgcacatcgaccgcgcgctcgacgcggcgaccaacgccggaatcaacgtgattgtgggaaccccgacctatgcggtacccacatggctcgtcgccatgtatccggacgtccttgccaccacaccggccggggaaccccactacggggcgcggcaaatcatgaacatcgtcaacccggcctaccgcctttacggcgagagggtgatccgatccctcatctcccacgtggcacagcagccttgcgtcatcggctatcaggtagacaatgagacgaaatactacgattccgtctcccacgacatgcaggtgatgttcatcaaacaactacgccacgaattcaagaacgacctcgaggcattgaacgaggcgtacggcttggattactggtcgaatcggatcaatgcgtgggaggacttcccggatctcaccggttcgatcaacgagtcgttgcgcgcgcgattcgacaggttccgccgcgatcaagtggcggagtatcttgcatggcaggcgagcattattcgggagtatatgcgcgacgaccagttcatcactcataatttcgattacgaatggcgcggtcattcctatgggttacagcctgcggtcgaccatttccgtgccgcccgcgcactcgacatctgcggcgtcgacatctaccatccgagcgaggatgcactcaccggcaaggagatcgcattcggcggcgacatggcacgttcggcaggcggcggcaattacctggtgctcgaaacgcaggcacagggtcagcatggttggctgccgtacccaggccaattgcgccttcaagcctacagtcatctcgcatccggtgcggatggaatcatgtactggcattggcattcaattcacaattcgttcgaaacgtattggcgcggactgctgtcgcacgatttcgagagcaatcccacctacgaggaggccgggaggtttggacgcgagatcggcgacccgcgtatcggagacacgctcagtcatctgtcaaaacgcaatgcggtggcaatcctcgccagcaacgagtcgctcaccgcgctgtcctggttccacatcgaaacgggattccccatgggcggcacgctcacatacaacgacgtgttgcgatccatatacgatgcattgttcgagctcaatgtggaggtcgatttcctgcccgcagatgcgagcgcagaccaactcgccggttactccctggtgatcgcacccgcattgtataccacggatcagcagaccatcgaccgattggcgcggtatgttaagaatggcggtcatctgctcgccaccatgcggtcattcgttgcggacgagaacgtgaaagtgtggcacgacaaggcaccgcatcatcttgtcgacatatttggcatgacctacaaccagttcactcgtccgatgggtgtatcgctcaaatgccccgacactttggccgacctcgccggcgcgtctgcaaacgacttcatcgagatgctctccccggctccggaaacccacgtactcgcttggtacgaccattatgcctgggattcatatgcggcgatcaccagacatgcattcggttccggagatgcgcagtgggtgggcacgcagcttcaggcggatgcatggcgcaccgtgcttgcagaggccctgtccaacgccggcgtgcacacccccggcatggaactggccggcacagtctgcgtgcggagcggaaccaacacggcaggcgataccgttacctacctgctcaactattcagggtcgcccatcaccttccgggcacccgcctcgggaacgttcctgctgggacatcccacagacgacggagagcaggccgtcaccgccgaaactccggtgaccgtgggcgatgccgtcacattgccgcgttggggagtggacatcattgtcggccggcaacccacaatgaattgaatctgcctccgctcgaccgaatccgatgcgtcgagcagacgggagcgatcgatatggttgcgccaccggcctttgggccggtggcgcaaccatatcggcaacacgtgtgcgacgacgatccacgatcactccgtgaacaccagagtactcaaggtgcgtgccggcaacggcacatccgccacaagcaggccgcccatgcgaatgttcaccgggatatcgcgctccgcctgattaaggaggacgacgccgattgagccatctgcgttgcgggccgagaccgcctcgatatcacgcgaatacgtgcttgtgccgagaaccaccgcattcggtttgatggcctgtgcaatctcgcgaatataccggtagctgatggtcagcgtataccgtccgtcgtcttcggcgacgatcggcgcggcgaaaccccctggggtatgacggggaccaccctgcctgtcgacgatcatgttccagtcgatccaccgctgcattccatggttcaggtcgccgatgatgtcgtgggcataggccgtcgcatcattgaagtccatctcgttcggagtggtcgtctgcaccatggtcttgtagtcgccatcgggcagcgcctcgatctgttcatcggtcatatcgagcatggtcaccttgccgggtatatgcagcccacagctttcggaatgcatcagcaccttgtcgggatacttgcctcgcaacatcgacagcgcctcgaaatggtcgccggagtaccagtgataagcgaaaccgccaacctccttcgccgcctccgggtcgctcatgaactcgtcgatgtgttcgattgcacgttccttgttatgatcccagatgaagatcttcacggcatcggtcagaccggcctcctccattgccgggtagagatggtgcttcaggaattcgcgctcctgatctccggtccacaggcagctatcccaactcgtggccgcagccgcctcgttctgaatcgacagcatcgtcaccggaacaccttcggccatataggcgctgatgaatctgacgaggtaccgcgcccacgacgaatagtattccggcttgagccttccgccgaaacagcgccccggcttgctcagatcgatgacatcgccctcctcgccgccgtacaccgaggcgtcgttccgcgtcatctccgggggcgtcttccattgcgccggaggcgaccatggggagagcaacacatgaatgggatgccccgccatggccatcgcctctttgagcaccggaagaatgtactgacgatcacggtcaatcgagaaggtctccaattcgggatcggccagaggatcctcaacggcctggtactcactgagcgagtaatcacaggagtcgatgtgtacgcggacgaaccaagcgtccattccagcgggaccgaaccattgggccaaggcctctttgcgcgtcgcggagtccattttggagagcagatagcatgccgactcggtgagcgagcaaccatagccctccatcatctggaacgtgtagtccgggtagattcccaccacattcgattcgacgatgtgctcggtgttcatcgcctcgtccatgaccgagagctccgtctgctcggtatgggttcgcccggcggtcacatcgtagtgcacagtggtcttgagcgccttcatcatgccctccttatgtggctcttctcaagttagtgtgtaagggccgtgcttcatcattgcttgtgtgatagagaaattgaatgaggaaacacggcctgaacccgagtttagcgtgttcgacccccaacgtttccttggtttggatgagatgggtcttcgtgtgctctcgtggcggcgtcttggcaggccggacggcccggggttaaggcagatcaggtgcgagccggactcgcacgacgcgcgctggtgcccctcgtgcggcgcgtatgccagggtgcgttcgtcgtggctgcgcacgctggcgcatgtgccctacggcgacgacgcggtgcatctgccggtgcgcgtgcgccgctacgagtgcgtgccgtgctcacgctcgtggagcgatgatcttgaggcggtgggcgccggcaggggcgtgttgagcgtgccggcggtgatgtgggcgctgcggcgcgtgtgcctggactcgatgacggtctcggcgtgcgccaggctgcttcatgtggcatgggcggtggtcgaccgggcggtgcgcgagcggggcatgctgttgctcgagcaggccgaccggttctcctcggtgcgcgcgatcggcgtggacgagcacgtgtggcgccacggcgcgttcggcgaccggtacgtgaccgtgatcgtcgacctgaccccgcgttgcgacggcaggccggcaagactgctggacatggtgccgggccgttccgcccaggtgcttcgcgaatggatgcaggcgcgcggcggcgagttcacaagacgcgtcggggtggtcgccatggacgcgttcgccggctggaagcaggccgtcgaatccgtcgtgccccacgcggtcgaggtcatcgacccgttccacgtcgtgcaactggccgccgcccgcgtcaccaaggtgcgctgccgcctgcaacgcgacgccaccggcaggcgcggtgtcaagggcgacaggctctacgactgcaggcgcgccctgctgaccagcgacgaatacctcggcgcacgcggccgtgccagactcatggccctgttcgccatccaggccaaccgcgacctcatgctcgcccacgacgcctaccaaagggtcatacacgcctaccggtgcgacgacaggcgacgcggcgaacgcatgatgcgcgagctgatcgacgacctgaccggaccggggcgctacaaaggctgccgggaactcgcctccctcggccgcgtgctcaaaagacgcatgcgcgacatcctcgccctcttccgccacccccgctcaagcaacggacccaccgaagccatcaacggcaggctcgagaccctgcgcggcaacgccatgggcttcgccaacaccaccagctacatccaacgatgcctcatccacagcagccaactcaaagacatccttacacactaacctgagaagagccccttatgtttgcttcccatatgcctgcaaccactcccgttacaccggcgcaccaatgcaccaaacacaagactagtgaactgtagttcactagtctcttcaagtcattttgattggaatggtcgcatttcttcatgcaacatcgacgttgcatagggacactatatcatttattgaactataggtagataactttgcggggagcattacccagccgacaatgcgacagatccaccaaacgaaaccgacaatcggtcgccaatcgccaaaaatgggcgcggaatccgcgcccaaacccagtctgcttcaatcagaggtcagatgccataggcgttatatgacgcacacagatcgttcattgcatgcagcattttgtagtggtagatgaacggccccaccacaatcagcgaaccgagcacctcccacagccagaaagtgcttgccgtgacagtcggcaccatgccccgcctccgctgttcctcgccgatgcggtcactgaaattatggaaccacaccagccagccaatgccaagcgtgagccaaccgatgaggaagtacatcaggcagtagttcatcgtcttcttgccgtcgcgtgggctggcgatggtattgagcgcctcggccgtagtggtcatgatcacgatgtcgtagatgccaaaggtgatcagaccaagcagaatgaacttcgtcagcgaacggttcgtgggcagccggtaggcattcggacgcatctgttgcacaggtggcgccggcatgggtgttccctgcatgggcggcgtcgcgtaagtcatatgtctctcccgttctctcactgctcgtgttcagatcgtccggatacacatcgccttcgcatacgtgaaccgtaagatcttcccccagcgtacggggcattccccaagcaggcgcacgattttcgctcatttttccttttccggcagttccgctgcctaatctgccacaggacgcgccatcggctatattcagcatatgcagcacacaccgatcgagagcattcccaatctgccagcccaactgaggcactacacggcagggcgccgactgtacgacagcagctcctcccccgaggcgcgcgtctacgccctctcaggcggcacccgcgaaaacgcccgtcccgacctgttcctcaaaaccgcggcgagcggcacgctcgcgcacgaagcgcgcatggacgacacattccatatgctcggcatcggcccggaagtgctcgaatacctacccggaagcgaatcgtaggcggattggctgctcacacgcgcggttcgcggcgaagactgcaccgcggaacgccatctcgccaacccgcagcggctatgcgacacatcggccactttgctgcgggaactccacgagctgccgcacaccaagcacgagcaggtcgcgacactcgccattcccgatgtgctcgcagactatctcgccaatgccgagcacggagtgcataccggccgtttcgacgcgcaattctgcggcctttcgcaggacgacgcccggcgcatcatcgccgagcggcccgaaactctgcattcggacgcgctgattcacggcgactactgtctgccgaacatcatgctcgacgattggcgtctcgccggtttcatcgacctcgaccatgccgggttctcagaccggcacgtcgacatattctggggaatctggacactgcaattcaatctgcataccgacgcatatcgcgaccggttcctcgatgcgtacgggcgtgatcgcgtggatcaggacaagctcgaattgattggcgcaatcgaaagcttcggctaggcaccgtgcccatgcaagcggaatgagcagcggacgaaatcggcgaatatatctaagcatttcaccgttattcaccccttgcagtgcgacaatgcgcgcatctacgatattttcattcacgaagcccgtcttcgttcattttcatgcccgcattacgcaatgccgcgcacgtgcacacagttgcccgtccccgacgcgcacgaaaggagtcgaatgccccacgcatcccagcagaacacgacaccagcacacgaactgcccctcgagaagagggcggcgctcacctcgggcgcggatgcgtggcatctgaacggcctgagcgagagcacctcgtatatgatcaccgatggcccgcatggtctgcgcaaggccgcgcagagcacatcaatggatatcgagcattccatgccggccacatgcttcccgccggcagcgggtatggcgagcagttggaacccgggactcgtgcgcgaggtcggtgtggcgatcggcgaggaatgcgtgcaggagaaggtggccgtgctgctcgggccgggcgtgaacatcaaaaggaacccactcggaggccgttcgttcgaattctggtccgaagacccgtatttcgccgggcatgaggccataggcatagtcgagggggtgcaaagcaccggagtgggcacgtcgctgaagcatttcgcggcgaacaaccaggagaccgaccgcatgcgcatcgacgcgcgggtaagcgaacgggccttgcgtgaagtctatctgccggcattcgagcacattgtgaccaaagcccatccttggacggtcatgtgcgcctacaatcagctcaacggcacgccgtgttcgcagaactcatggctgctcaccaaggtcctacgcgacgaatgggggttcgacggcgtggtgatcagcgactggggtgccgtgcacgatcgcgtggaggcgctcaaagccggactgaatcttgagatgccgcccacgaacacagacgaacaggtggtcgtggcggtacgcgacggtttgttggatgaggaccaacttgaccgcatggcacaggggatgctcgacctcatagaaaaggctgctcctgcaatgcagcaggacgatcacccctacgatctggtgaatcacggtgccatcgcacggcgtgccgcacaggaatccatggtgctgctcaagaacgatggcgggattctcccattggccgccgacggttccgtctccatagccgtcattggcgaattcgcacgcacaccgcggtatcagggagggggatcgtccaaactcaccccgacctatgtctcgtcgttcctcggcagcctgcatattcgcgacattcccgtggacttctcccccggcttcaccttggacgatgccaagcaggacgccgcgctcaccgcccatgcaatcgacatggcatggcgcaacgatgtggtgctgttcttcgcaggactccctgaggaagcggaatcggagggcttcgaccgcgagaccatcgacctgccccaaaaacagctgcgactgcttgccgacattgtgaaagtcaaccccaacgtggtggtcgtgctgtcaaacggatcggccgtctcagtcacaccgtggcgagattcggtcaggggcctgttggaggggtggctgctcgggcaggagggcggcaatgcgctcgccgatgtcatcttcggcgatgtgagcccctctagcaaactcgcgcagaccatcccgatgagcgtgctcgacgatccgagcatgcccaactggcccggggaggcagggcatgtggattacggcgaaggcgtgttcgtgggctaccgatactacgacaccttcggcaggcaggtggcatacccgttcggatacggcatgacctactccaccttcgagattcgcaacctcagtgcaatcccgcatgacaataccgtgcaggtgagcgccatcgtcacgaacaccggtcaggtgcgcgcctcggaagtcgtgcagctgtatgttgcgccatgcgcctgtgatgccgcccggcccgcccacgagctcaaaggattcgagaagatcacactcgacccgggcgaggccagcatcgtcacattcgagctcgacagcaggtcgttcgcctactggtccgagccgaggaacgactggcatgtggaacggggcacctacaccattgagatcggttcgtcatcacgtgacatcgccgaacgagtgcaggtcgaactgcccggtgacggcatacgcctgccgttgacgctctcctccaccttcgacgaatggagcgacgacccgataggcggcccgatactgcaggccgcgatcaaccggctgtcgcagcaggaggggcatcccatcattcccgaaagcgacatgctccgtatgctgctcggcagtatgccaatgaacgccaccaacgttctgctggggtctgcagccggccgtctctgcgaacgcatcatgggtctctacaacgccagcaaccaatgattcacgtgaaacgtggtggcgttgggcgtcagcatggcaacgtcccgcaccaccacgttcctcacttggcaaagtcgcggatatataccgttcaggagcgcagcgcgcgcaggctctggccgaagatgctcacgatggccgtcggatcgcggtgatcgaagaactggctctcgtgcttgtcgaggctggccatcgtggccatgtcctcgtcgctgagctcgaagtcgaagacgtcgaagttctcggccatgcgctccttgtgcaccgacttcggaatggcgacgatgccgcgctgcagcagccagcgcagaatcacctggccgttcgtcttgccgtacttctcgccgatcgccgcgatggtcgggtcggtgaagatgtgatgcttgccctccgcgaacggcgcccaggcctcgacctgcacgtcctgctcctgggcgaagcgcacttcatccttctcctgataccacggggagacctcgatctggttgacggcgggcttcacattgctcatgagctccagattgatcagctggtccggcgcgaagttagaaacgccaatcgagcgaatcttacccgcctgctgagcctcctcgagcgcgcgccatgcgccggcgacgtcgccgtacggctggtggagcaggtagagatcgagataatccagcccgagcttgcgcagcgaatcatcgatgccctgcttcgccttctcatacgtgaagtggtcgacccacagcttggaggtcacgaaaaatgtcttcgcgcgggaccgagctcttcgcgatcgccgcaccgaccgcctcctcgttcgcatatgcggcggccgtatcgatcagtcggtagccggtctccagggcatcggagacggcctgctcgcacacggccagatccggcacctgaaacacaccgaatccgagctgcggcatcttgtttccatcgttcaaagtgacgtactgcatgagttctcctatcatgtctattcacgttttccgtgttcacccagaatcgtaaagccgttgttcggcgaagtacaatgcctatcatttatcttgctatgcgcaatctgcatagtgggctcggtctcgaagacgaacggagcgatatgaccgaattggaagcactgcgcgaactcgtcgccttccgcgaatacggcacattgagcgcggccgcagacgaactgcgcatcactcagccgaccatgacgcgcacgatgcgcaaactggaacgcgagctcggcgtcccgctgttcgaccggcgcgccaagaaccggctttcactcacccacaccggcgagctcgccgcacaggaagccgagcaactgctcgacgcctacgaccggttcgtcgagaccgtgcggaacgacgcgaatctgcacaacgagatcgtcgtcggatccgtggcaccgggtcccctgcattttctcgagcaagccggcgagcgcaatgccaaatgggaatcgtccatcaccgtgcggcacagtctcattgagcccgacgcggtgctcgacgacctgctgctgcgcaaggagacgatgatcatcaccgaccgcgaagtggacgacccgcgcgtggaatcactgtacttgggcgaggaataccttggcgtggcgattgacaatttcaatccgctcgcccagcgcacgagcgtcaccttcgccgacctcgccggcatggatttcgtggtcgcgcacgacataggcccgtggcgagcggtcatagaggagcagattcccggcgcgcacttcctgtaccagcaggacctgagcgcgctcgaacagatcagcaaatactcggcgttcccgttcttctactccaatctcacgagatcgctgcgcatgaccgacgaacggttcatgccgcacacgcgcacggcggtgagcattgccgaccccgccaatcgcatcgacttctacgccacgttcctgggcgacaaccggcggctcgccctgccaatccagcagtacctggcccagcatcggccgcgggagcagtgagcggaggcgtgaatgtgcgcggtggtgtttcttgcgcggcatagttcgcggaaatcaccgtgagatatgccgctttgaccagcacgcggacagcaagcagtctttcccccctctcttcccttcctttgcgtaaaaagagtcaaatagacgcactcagatgtccttttttacgtaaagaggactgttgtcagtatgacggaagcaccatcatgtcaggctggatgaagcaccctagcagcatggatgtgaccgtatccatatccttctgcctgagcgatccgatcttcacagcgttcctggcagagagatcgagcgcccggatctgctccaactgcacgaatccatccgccacaccgctcccaccatttgacacatcggacgccggaacaggggaaaagggtatgtgcagctcaaaatcgccccggccatgggaaatagccgcaacaacagtgagggtgcagttccggttgaaggcatcattgctcaccacaaccacaggtctgcgcttgcgctgctcatgccccttggatgggtcgaggtcaaccatcaacacatcgccgtaatggcacatatcacagaccctcattccccgctggagcaccgaaatcatcttcgcaggcccggtagggctccttgcgatccttgaaaaccgaagcaagattcgcgacacgaatcgcgcgctttgccgaccgcgcgggcttgagcacaatcgcaccgttttcgacggttgcctcaatctgcgaatcatcgggcatcccgacctgctcgcgcatcgccttgggcaagcgaaccgcctgcgcattgccccacttgctcagtgtcagcattgtcatggccactcctttcagtagatacaagtatatacttcatgttcgccagctgcaacgcgcacaatgcccacgaggaaccgaataccgaaagcatgcaggccattgcagaaggagacgccttccttgccagcggtcaagaggggcgcttcagcaacgccgaatcgctgatcaaggcagcccttaactgatggcacgactcagcgcggacttctcaacggcattcagccgagatctcaagaagaaggcacagaaacgacagtgggaccttccaagctcaaggaggtcatcgaactggtgatcgagaactcccctgcatccattgcggtgctcaaacaaaggcataatatgcatacactcgccggaaagtggcagggacgaaacgaatgccatgtggcgaacgccggcgatgggccggtcatttggtcttgcaacggcaaagtcgccttctttgagcacaccggttcccacgacgaactgttcggtacataatcggtcatggcggcatcaccgtcgaagcagatgacaatacccactttccctctctttactttgccctcgctccgccttctttctgcctttctgcgtaaaaagagtcaaatagacgccctcagatgtccctttttacgcaggaaaggctgccgataatcggatatctatagttatgggagattctggctacagatatctcactggcaaaaccggagcaccatcatgtcgggctgcgcgaagtagtcggcggcattagcggtgaatcactcaggattgccgtcaaacccgcgcatcagcgtaccggactcatcggtgagagcgcccgattcgtcaagaatgggcgtatcgagcacggatttgatggacatggcaagcgatgcgcacgcggcgaccgactgcttggcttgctggtcgaactgcgcgtaatcctcgccctgagcggcgataacctcgtcgagattgcgcaatgcgacagagaatctgacatcgagctgagtcagcgtagcatatacgactcacccgccagcgctcacagacactacgcgaaaatccacagaacgacattgtaaaaatagtggcccgccactgcattttccgcgtacactggaatcaatcggcgaggaggacgagagggggcatcaatggataccgcacggcagttcattcccatggcgcccgtatgcacggttaccgcagatcaagtagtacatgacttccaaggagatatacctgcaggagtgaaattccgctgcccatcgtgcgaccgaccagtgcaattccaccgcggcagtcgagcgtctacaacatctgcggacgcatctggggaccaagctcccgcagttcgcagaaatccacggagccactcatctcgttctgttcaccgaactgtacggccgcacttccggcatgcgaagaacgacccagtcgccagattctgcgaacggtatcaagcgggtttaggggctgacccacgtattatcgtcccctctctaccgatgttcctgcgcaaagaccgcaaccgagcagggagcggccaccacgcacaaagcacgcccacttttcatttggagatatcggttcgtcgtcgatcactcgggcatgatctcatctccgaactgcgcaaagatcgcgctacactcactgtagacgggatctcccacaatcttgccgatcttgtgtccgaccgcaaatacaccattcacctggagaatccctccttcggattacgtgcacgcatttccgtcccggaacagtggcagaggaatgtgggcagtcccgaagacggcgaacaggcgttcatcttcacctcggaattcggcccgaatggaggccgtagactttcctatggggcttctctccacgccgggtttgattactatgtggttgcacgccccagcattctacgtgctcttcagagctgtttcgacatagccgttcccatcggcgaaatcaactcgtcgcacggcaatcttctcgtggtgcgcatcgtcacgctgtggaattcgctgaatcgtacacaagctgatttctggcttgcagatcacggtttccgactcaccagtcttgatctcgaccccgttcccgtttggcctccccaactgcgttctaacggcatagacgaacccttgttctcgaatagtcagcagatataccagacaccatttgcatcccgcaacgaaaatcccgtacacgatgacattgattttccgcgtctcaactgtgatcatctcaatccacgacgtgttggtttgcttggttttgccccacatggccgagtccgctcacagatagagggcgaatgctgtttcctgcgtgcgaatcggtatttaccatggagtgcttacgtgctctcacacacataccctgaaggactcatgttggcagatgcccctcatctgccttcatctgatgagcagccacacgcctcctccactgctctgatgcccgaattggcaataaagcagacacagtgtcagacactcaataaacatctcgacatagagcagaggagactcgaacagcctcaacaccatggcataccactcagtgtctcacttgcccgcatacgttccacgtaccgttaacacactcatcactttgggagaagcagatgtcacagcaattcaacgaatctcggcagtcctggggtctctttgtctggaacgacaatggtgacggacaattcatacgcatcatcgattacgtgaccgattccgcggggaacggatgttatgattgggtggcttatccgcgctggtgggaacggtccaggaacccgtcttcagatgaccctcttgacccgaagaccctatacaacccaaaactcacgcaaatcatggtcaagagtgactcggatttcaagtttctccagtggacaccgaattacaatcgtccagatcatccgtttgttgagatctttcaaggtggcctacgaaccaccgagcctccgctgtatgaggtgattgattgcccggccaatcgtgcggaagagctacctgacgtgctttcgcaaggcatacagtattccggccgtcccaccgcgaaaatcctgctattgttcgcagagaataacaatatgttggacgcggccgtcctcgaccgcagtatgacaacgattcataatggcttgctcacactgagcaacacagcaccgaacagcgtcccacgcgtcatcctggatcgccgtcatgtgcgaatcatcaatcagggtttcaatagaggtgaccgtctggtatacaatctgccgacacaactgaagtctcactctcaagtagtgatcaagcctatgcgagatctggcgcagttgtacgtgaactggtacatccgcaaagagcatgcgatgaatggtgacgagctcatgcgcacagccggagatgttctggaacaggcattcgagaaaccggcgaatcttgaagagtacctcggtgccaaaccctcacataacgatgtccgggcacttcaaacggcaatcaaagcaaccattcgcagcaataccgacgatgtgtctgagatcatctacgatgtgctgaaaaacgacgacgacgtaatggcagaattccggaagcaagccactgcgcagctcgatgacgaattcgagaagcacaagcaagtattatgcaagcagctggatgaactgcgggcccagcgggatgaggaatcagaaaaggcggaacaagcaactgcacagttggcggagctcaatcaacaattgcagcgcaaacgtggtgagatacgcgatgcacaggcagagttggagttgcagaaagaggaacaacataaagcgctgcaggatctggagaataatgtggcactcaagctcggcttgcagcagattgcccagcagaatcattccatgatggaggaattgactatacggcactcgactgcgccagattcctccagacaacttcgcatggcccccatgatgggaccagcgaaaacacaagcagcaacagatatgcaacaggcagtggcgcagaatatgcagatactaggctgcaccttcaccggacagagcaacaggaacaatgaacgaatcacgcatttcgccgctcatctctgccgtacactgcgcacaacgcgattgctagcggtcgataccgtccatgtgccgaccatcgccaatacgctagccttcgcgctcgccggcacaccagcacagcatactggaattccaatcgatttcagtgatttcacgatgctggaagagtttcttgagcactctgagtcgccggtgattgtgctggataacgtgttcgacaccgtcaatgaaagtctgctgttcgcattgaaccgatatagtcctgcgaaatcagtagtgattctaccgatcggcagttttgcgaatatacgtcttttggcacctgaagtgtggaacaaggtgttctatgtgccaacgactgggatggtggagctttcggcttcagataagccgctgcatcatgcgcaggaagcgctcaagcgaatcgacataacttcaagatcgatactggcgcaaatggacatcctccgaagaatgacttccattccgcagaacgcattggtgacgccatccgccatcacggcgattgcacaggacactgcatcagcacgtcaatggatcatgccgcacctatgcattgaaacatatgaataccaaggagcggaaaaagcccacgaattgagccaggaaccgaccaataaaaccattgcggctcaactcgccgcactcatcgacaggattgaccatggttcgcaggctcgttgatgtgatggcacatgacttgggagtgccacgacgggcgtccgatgaccctgacggggaagcgttggcatgtcgttgcacattcacagcgttgcggttctggatgcaggcgtattgcattgatgacggctatggaggggcagctggcatcgcgcagaccgcggtggagcagaaatccttggcatggatcaagcagatgagcgccctgtatccgcagctgcgaagcaagtttacgccagccctgattcaccaatactgctcagctttgacagctattggagatctggcggaaaccagcgagggcatgttgcggtgcaccaagccacatgaccttaggattccgtacagcggcggcacgtttgtgatcgcgcagctgggattacgtgatctgacggtacaggattgggaaggttgcgttctttccgatgccgttgtatttgccggagtaagcaaacacaacggcatcgtcgggtttgatccggatatgattggctgggagctcccttaccgtgacgagctgctgttcctggcaaaatggcaagaagccagtaacgcattgcgttgagacagggctgccacctgactcagctcatcagcctttctcaatctgagctaccggcttccattgagccccagatgcacccctattctcatctgtgattcctgtgacctttccgagctctttcacgcatttccgcatgtatttcacgcttctcttcatattcttttcacttttgtcgattcccttcagcgcctcagaacgttcgcgtttagcgctaggatccgaatccgcatctctgctaccgctttgctttatgaactgcttgagctgccccaagaagtcaagctgaggctcagtttcccgtagctgctcgcacacactctgccgcacctgacgcacgagttccacaccaccgtcgatttccatcagtacatccctgcagaacactatcagttttgcgcaggtgttcagcacgtatgcgtcttgatttgcaagcacccaagtgcccaacgttgccgcgccaccgccagtaacagcccccagcaatgcgccacctcctgcaatgagggctacgcctcccgacattccaagaccacctgccgccagcgagccgcctcccaccgcagcaagacttgcgctcgtcaaagcagctcccgacaatccggccacagaaggtccagctaggattggcgcaatcgccggtgcgaacacataagcagcccctcccgtcgcaacagctacaaccccgattccgacacaaccggctagaaccgctttcttcacacctttgattgccgacgtctccttaatcacagcttttctgtatttggtgcattccttatcttcaaaccccggcagatcactgcacaccatatccagcgtcgccgcatcgtatttcaatttcttgctctgatacggcatgaactgagaagcttccaatgccacgagtttctgccagactggagtagcatacctctgaattcgatgaatttcatttacgagtgcttctttgtcgcgcaatatgaattcagagcaattatcgttctcccaatcgctgaactcccgttccttctcctctcttgtcttcttgttcttcgtctgttcaatgtcgaggcgagctgcctgatactcaatggaaaccaccatattcgcctgcgccatatccagctcgaagaatcgcatgaccgaggcatcatcgccatagccgtttcctcgcccgtgaaactttgcctgcaaacgagtctctctcttcgctttcgcatgtaccttgtaatccgtatgcacggcgaagacgaatcgcacgacgcccaccacatttacatgtagcaggaaatccgacaccattcccggattgagcttccctccgctacgcatcagcgtgcgaatcgccccatccgtcatatcgacaacagagaacaccccagtcgctatggtgaccatccgcgtacccaatggcgaaccgtgtggcaacaatgcgtcaagcccaacgctcagcaatgacttgaaatcatgcacttccccgttcgagcacattgtatacagtcgccgggctgcatagcatacgcagacaaggcattcgttgaccagcaccggcaccgactgcctagcaagttcatgcgcgattcccaattccgctcgcaaatcgaagcgtcggtagattttctttccttcttcgtcgacggtcttgagcaacgttccgttgaacagtttggacagcatcttcctgaataacgcctcatcagtcatcgcatccttgaacagaggaagcgcggatagctgcttcatcaacgaaagtatcggccctggaataccggtccccttccccgctgatccactcgaacccgccatatcgctcaccatatggaagaaccaacgcacagcaccgagcatgagcttctcttctatagttttcccgatgagctcctcatctgcaacaggcacgaccataaagacaccgtgctgatcggtgccatacacctttccggtgaactgcgtcagcaatgaaaacgcaagaccacccaagctcatgtgatgcgagaaatccctgagatgatgctgacgaccaccaccgaactcacttgttgcacgatctcccacaaatggatacttcttctctagaaaacgaattgccgactttacgtcatcgcctttatactctggatccatcttcgcgactgccatcacaaactcattgacacgctcgcttccccattcgcgagcgcgatcgaaatcaaacttccccacccacaatgagtcaatagcgccagagatgattccacagccggcagcaagcatgtaatccacacgatgagattcatcctgatcgctattgttttcttcctcgatatcctctatttcgatcgttgtatcttcatcaattcggcttccggactgcgaggcttcatctttggtgccttctatgtgacgctcggattgcaaaggctcgagagtgtaatcgatgtacactcccctatcgaagtgtccattccacgtctgcaattctccactgcccatgcgattctcctcacctttgagacatacgttgcattttagcgtatggctcacattgaggtagagaagaagcagttgcggggaagttagattcctttcccgctacagaatccaactttcttgcatcacctcataacctcaattcctaattgaacacatacacccttctgtgcctagtgggtgccgtcctcgtcgacatgaacgggggctggacgatccgccggttcatgaacgccaaggacatacgcaccgcgtcgagatcacttccgagatgcaatgtcgggccgaccaaatcatcatgatcgcgctcgagtccacagcatgagcatatactcaaaaacaaccgatgccggctacgacgctgacaccaacatttgaaacgtaatcagggtgtctcatggcacaagaaaccaggatttttacaccgcttcaaaatcttagtcaacaattcggcacaaacacatgaaatacgcatttcagcctgaaatcctgcgacagacattacacagtctcataaagatttgcatatgcaggatacgcacactacggttaatccatatggaagatcaagtgagaatttacgacagcgcagccgaggaagaagcacgtagagaaagcgcccgctccattctaaatgcctacattcagagtcgaatcgctttttacgatggcacgggaagctcctcaatgacctatgagcgtttgctgggcaaggattttgcaatttatgctctgcgtggtattgaaaccgctgaagactatgcgcgtgaggctttccacgcagtcgaatcttcaagcgaagagacggcaatgggtacccgttggcaggagttgattgccagcattgccgaaaacgctattgatacgggtgatttgaccgcgaccagagatggagcggtctatgtgattgaactcaagtcacaagagaacacgaccaattcatcgtcgttccccaatgaattgaggagtttacgtcaacgcatgaaggagattacgggccgtaaacgtgcttcgaatcagagagtggaggcagcaatctgcatcacgcgttcgactatcagtaaagacgaatggcgtacgttcgaggtgagcggagtgactcaggagaacgccgatctcaagaattttcgttaccgctatctgtcgggcactgcaatgtggcagtggctgtgcggcattgactcaccgtatggccttattcgcccattctcaagtatcaactctgaagccgtgcttctggctcgtgaatcatcactcgagcgagtaacaacgcaactgctggaggagctcgataagaatggtcttccacatacactcgacggtgttgccgagctctctgacagatacaaggccgaaaaagaggcgaaacgccgtgaacgcgaagccaagaggaacgccaggaatactggcagataaaggactttcgcagattccaatggaggcgtgcaaatcattgatttgatttgcgcgcctccataattgataatttaagatcactaaatcctactattcaggccagattccagttttgatcgctggtatgggcatatcttgaataggggaaattgcgccaacgctcatcatgagcctctcccctcatgtcatcgagaattgctcggccaattgcttcgcccaagctgaccggaacggcgttgccgatttggcggtactggtcgtgaatgctgccagcaatccaccaatcatcagggaaaccctgcacccgtttatattcttccacgctcagcggtcgcagctccttgggatggcaaaggtcggtggctggcatcgttgggctggtgaccagagtgggggatggtctatcccaagcgatgcgtcggtagaatccggtcttgccgcctccaagcttataggccttacccatagcctcctcttgaatttcgatggggagtttgttccagcactgcccctctttcagcatgctgaagtaaagcaaccgcttctcagggaaatcagtgtgggtttgccgagaatcttcaatatcgtagacaacgtctcggaacgttacccaagagggaagattccagttttggacatatttgccatcaggatcagtatgcgtaggtatgagccagtcacacttcgtgccatcacgtttggcaataatgaccacacgctcacgaatctgggccgctccaaagttagccgcgttgtagagattgaacgaaacaccgtagcccatctcttccaacttattgagtatgtagcgcatcactccgccccggattggcttcccgccagattcaacgggaaaaggggtggagagcagtccgcgtacgttttctatgactaggtatcgcggcttcaattcggaggccaagtccaagtatctgagaaatacattgccgcggggatcctcgaatgcacggcgcgcgcctgctgttgaaaatgcttggcatggcggaccgccgaacatcacatcgatttcacgcccctgagggatacgggccattcgacgaacctcgtcggcactgattttggtgatatctccgagcagggcgacatctggacggtttcgatgcaaggtcatacggcattcacgattgttctcacaatatagtgccgccgatatgccagctcgctcaaagccaagatccagaccgccagccccactgaaaaatgagagagcgcagatgttgtcctcgaagtctttagttgacacttgatccaccgcagcttgaatcagattattccgttccagatatgcgtcgatggcttctttacggaaaactttacgagctccgcaggtgtcaaactcaagttcgcccgtattcgcgagacgtgtcactacacccgcagacacccctatatattgggctgtttccttagtgttcagcagcgcgttttccgacataccccaatcatatagtttaacagggactacaaaatgagtactttcggtgattccatataccactagaaccttggaggcgagaacaatagcgcaatcccgtctcacaccatgctcgagactcaactcacaattgaacacacgcggcatcgtcgcaatacacttgccaatagttaagttcacacgccaaccatcgctacaccaagaccgaattgctcatgcagctaccacctcacaaccatcgactcctatacctaattaattccgccctcacccacgagctcaaaactatttgcgctcaattaagaattgaagtcgcaaggcggcacatggaaaaaactggaaagaatgtcaattttcccgcaatacttcagtctaccagaaaccaatgaagtaaacaaacgggcgccaaatccgacacagcagcacgaacgccgagccagggaaccaccttgcacgaccacaaacgcaaacacatcgaaactgccagcaagattcatcaatcagaccagcatgaccatactcgagtacgcgacataagcatataagcaaaaccagccaacgccgatgacgaccctaacgccgacaatcaaaatacaatcccagcaaaacaaaaatacgagataattcgtcaacacttttgagattttcgaatatttggacgacagcacgtatcggcaccagaacgcgcgtttagccccactcaaaaacatgccctcaataccacaattcaaaaattctgcatcagccgcaaattaccaccactttcaacaaccggcatgttggcatattcatagcaccttcaacaccaccttgcttacccaaaacataacacataacagcaatatcaactaccaccaagaccattcatatactcaactctatctatatattttaaatgtattttcatatatagtcttgcttttatagaatgaatagattcaatttcagcaacaagtatccaaggacgacgctttcgaagcttctccgacaactccccgctagacatacgcgaacaagcaacgcagaacaatgaccagaaactaagcgataatgcaataaaaaatataattacataatgaatactattatgaatgctatggaatacataaaacaggagaggcaagaggggtacgaaacagctcgtcacaagaagtagcccattcatcccatgttcttcattttttaacaatgctacaaacgtcagacaataaataaacaggaatacaagcaagacagatagaatattgccattatcatacctcgtcgccgataaggcatccgtaatcagcaacacccaaggacctatagccattataagcaaaatagaaagcaatacaaaaacttttacaagtgatcttgccgcagacctttcccctccgtatcgttcgtatagttttaaataaatcaatgagaccgatttatcaaaagccatccttgcattgataaagtttttttgcccaatgacaatactaaatctacctagataataaagaataatgattgaggaaacaattaccgcaattgcctttatcacaccgagaccggaaaatagagcacgagacataaccgcaagcacactacaactacccacacacagccagtatgagaatttactcaatatcagcatcttcccttccccctccacaacaacagcaagagcaatcgcaagggtagacaggaaagaaaacagctcaagcagcaaagaaaagggcgaattgacattcggataaaaatctataaagtaattatataattcactccaagaataattatattctttttttctgagcatgtattcgatttcatggacatatgcattaacgatgcttaagattaggacaagaaggcaagatgccgccatgtatcgtttctgcccattctccgtatatctcagtatacgtacatcaatcttttccttgccagccaactctatttctcagacttccttaagcgcatatgtaggaatttcattctttgcatcgccgatgagatgctgccgcgttggcgaaacaatgtcatttgtctcgccaacgtacacgatgtaccgagtttcagaagagtctttcctctgcttgacatcctcggcatgcacgatgtaaacgaccggatactgctcaagatactctctggcatgctgttccaccaccgaatcagcaggaatggattgcttcaactggctctcgataatggaatgtagcgtctcctcatccagctcgcctggacatgcgggaatatgcacgatgtatgtgctgcgcgacgacgttgtaggcatactcatactgcgcatactagcagctttgctaccatggcacccatgatctccgatgacacgctccgcatgatccaccagttcagcgcagaccgcgactggcaacaattccacgcgcctgccaacatggcaaaatctgtgagcatagaagcgggcgagctgctcgagtgcttccagtggagcgacgagccacgcgacggcgactgggagcacgtgtacgaggagctcgccgacgtgatgatctactgcatccaaatggccgacgtgctcgacgtcgacctcgacgagatcatccgcagcaaaatggcgaaaaacgccaagaaatacccagtggaagcaagccgcggctccagcgcgaaagcggagtgagacaaacgcgcacgctccgtccgccgttccgcatcccgggtgcgtaaatagagtcagatcatgacactatgccgaccctatttacgcaaggaaagcagtacatggacctgtcatctccagactgcatgctcacactactattcccaagtctctcccgtgcactgccaatcccgatgccatatctcaatctgctcatttagcatctgccgaatcttctcatctgccgggatcgtcgtatcagccgaatcctcgcaggaaaccacctgcgtataagcagtgcaaacctgaaaggagaaaccagatggcaaccacggctgacggtcggggaaatccacggcataggtgcgcgcacccgaatcataggcgacttcggcaagcacatgatgattcagcatgaatagagccatggcacaagcatacttaccaagtcaatacgggcagttcgaaaacatgccccatggaaggggccttgcgaggagataccgcatttttggaggcatgcccacaaaacctgtccgtgaagtgaatgctatgcgaggaattctccatgttttcaacatctaggcagtggctgtacaagcctgttgtttctaggaagtaggcgaatatgggagtgtatgctcgggcagatctacttttgtcgcatgcttcacaatgtccaggaagtctttgtcctgcacatgcagataggtgctgaaaccatctgttcgccgcattttcaacataggcataccaggacactcctctggagttagacctggttcacagtagctgaaaatccagtatggtccatactccaccacagagatgatctggagatgcgattgcatctcggccgccttgcgcaatgcttcctgaatgcccataccacaccgccccacagcatgaacgcttaactacatggagcgaagtctgcggaacctgtgcgatcttctcttcacaagaagagtcaaaacacagctcccaccgtccctttttacgcagaagcgatttcgggagattagcgttcgccgccgttccgcagccgcgcaccaactgccccgcacatcagaactcttcctcgcaatcattgcagtgatagctcggcgtcgggtggaaaatgtcgatgtcgcagccgcccagcaccaccttgccctcagcgagctcacgctgcagttcctcagtgaacgcaggcataccatgcagaatctgcgccacatgccgcgagccacaccgtgggcacaccacctccgccgattccacattttccgcatccatgtctgcgtaatctcccatattcgccattctcgtcgccctcctcggttccgcaaacagcataggcacgcctttcgcattctcagatttcctcaccgctcttcccatcttctcaagtatctatatttcccttcctctctgaattttctcgacataacagagtcaaaatcacacccagtcgtccgctctgcaagaagagcggtacccgagccagcgaggcacgtttcacggaaacatccgcataaccgaccaccaagtcacgcagatgtggctcgtctttcggaagcttccgaacgatatgtcgtctgcagacttccccgcagcacattccacggaatcttccgtaagatatgccattcacagaccattctgcggcacagctcacggaaacatccgaagggacgaccgcgcagaccccgttccacggcacaacgtacggaagcttccgtaagatacgtcattctcagaccactctgcggcacagctcacggacgcttccgcaaaaccggccgccaaagcgatatctacggcacagctcacggaaacatccgcaatctatgccgcaaaatgcgcacatcgcgacctgattcatggaagcatccgcgtaatcgaccacagaaccgcggctgtatgccccaacccgtagcgcacctccttatctgcgtaaaaagagtcaaataatctttctcaccgactctttttacgcaaacaaacgccatacacatctcacgccggagaatgagccaatctcagtcagtcgacaacgacgccgggtttgccaatctcgtcgagccgataggcaatctccgctttcgatccctcttccgccacaattttcaccgtgctgcttttcgcattcacattgctcatacccaatgccgtttcggctatcttcggcgcacattccagattccgctgctcactttgcgttccgagtgtccactcgatgctcacactgccctcacccatgcacaacacgctgagcatgtacgatttgcaatcactgaacgtgagctcatcctgattctgtagactgggcatgcccctaccgccatcgcgttccgtgtagctggccgtcggatgcagctccccaagcaaagtcagattccctgtcgccgtggattcgccgattgattccaatctgagctcaagttcctcaacatcggaactaggaagaatatgatgctctgattccatgttgcctatttccccgcttgctccgcctgtcgccgtctgcgagctttgcggggatttcgaaaaccctgcctgctcctgcgactgtccgcaacctgcgaatcccccaatcatcgccatcgccgcgatcacgctgacgattccccgccattgcctcattgcaatcaccttctcaagcaaatagaaatctgccaatttgattatatatataaaagttttgtcaataaaaccgcacatcaatacgcatgccgcgagaaggtaaggcgcatgcacagatcgttcttagaaacctatcgaaagatttcacctgcgtaaaaagagtcaaaatctaggcgtcaattgtctccttttacgcaagaagaatggcgtgtttcacggaagctcccgtaagacatgccattcccagaccaatccgcggcacggctcacggaagcttccgcaaaaccggccgcaaagcaagccgcgccgactgccgctactcggcctcggcaatcgcctgcaacgtggcgtcggcctggtattttagcgacgtgcgcatcgccgcgttcagttcgagcttatcggtgctgaacatctcgcggttgagtgtgacgcccgtgaacggcaccggcacaatgcgcattttgaacagggtgagcgagggcatccacgccgcgaacgcgtaccgcagcgtgttcagaccgcccacgccgctcatcgtcatcactttgccggtgagcactgacggcgtgccatcttcgagcggtcgcgacagccagtcgaacagattcttcagcgaccccggcacactatggttgtactcgggcgtgaaaatccagatcgcatccgcctcgttcaccgcaacgcgcgcctcggcgaccgacttgggcgtggggaattcctcgtcctgattgaacaccggcacctcgctccaatcaagcacgctcaccgacgcgcggtcgccgagctcctgctccgccattgccgcaagctgcttgttgaacgagttcttgcgcagcgatccgacgatcatcagcactttcatttcgcgaccgtcgttcacttcgatacgttcctcattggtgagctgtgccatgccgacctcctgtactcgatgtgcgattggttcacactgttgtcactattaacagtcagtacaggcgtgccattccacttcacgccattggctaacagattccgcacgccaaggcaatcctgcgcagattcctagggttccttcagcatgcgtcatccgttctccaagatgcgcgcgtctatagtggagtcaccagctcacggagcgcggcgaaggaaaccgaaccgcattcgcggactgacacaactgaatcccttcttcttccttctcttctctgtggccggggtctgcaatgcagatcccggcccttcctttgcatctgctacatctgcgtgtacccgcgccaacgcgacagccagaacgcaccaattgccttgctttcctcgtcaagctgcgcgcgggcatcgccgtccagattgaactgccgtgcgggaatcagcgggaatgacgcagtggggtcggtgtcttccgtatcggagtcgttgacgacgactcccgaacgcagcagatcgtcgaaagagagcacggtgacggtcagccaatctgtggccagatattcacgcagccagttgtacacaaagtccagcatcgcggtgctcggttttgcgggcaccggcatcatcagagcgtccgtctcgcgcagctcgaccgattcgtatcgcgactggtcggcatagtgcacgcccacaaggtaagcggcatcgggcactgccatgaaccgcttcctctgcgcggcggaatactgcgcatacaccacgaacggcacgaccaccatggccaccatggcgaggaatccaggcagaatatagccgcgcatgccgagctggagtgtgagcaccagcaatccgagggcgagcgcaataatcagcaacgccatcagtacggggtgggattccccgcgtatctgggagatcatcgtgatgtggctgcgcaccacgctcgcctcccgtttggaggcggcctgcggaatcttcgccttgcgtgagaagtagatgaggaacggcgaaccgatcaccgcgaacagtgccgcaatgaatgggaatacgatgaccgggtagcaccattcgccgaagtcctggagtgccgcgaccacaaagaagacggcatctgcgagcagaatactccagccgatgatctgccacagcaagtagggatgacgtttcgcaaagctcgtgccgtttgctgttccaagatactcatattccgcatatcccgaagatcccgaatactccgccatcgcctggcattcctctcataccatgatctaccatgatcacgcgcacgctcacctcgccggcttcacactccacgtggccacgaaggtcggcacatggtgttcgtgcagattcccctccccgttcgtgtcctcatacagcgcgcgcagtgtgaatcccgcttcgagctggccgccgatctgttcgtcgagcgtgtgcgagaactgcatgccggcgtcttcgtcgagcagcagctgccgcgcacgctcgtcgtggagcggattaaacggcagcgcatatgtcagcgtggtctcctcgttgtcgaagatgtagttgatgccgttgtcgtagccgccaatgagcgaaccgcccggcttgagcacgcggtagcattcgcggaacaccggcttcacctgctcgatatagcaattcgacaccggattgataatcaggtcgaagctctcatctgcaaacggcaacggctgcgtcatatccgcctgaatcacttcgatgtcgtagccctcgcgatctgcgacttcgtactcacgctcgcattggcgtgacgaatagtcgagcaccgtgcactgcgcaccgagcgcggccatgaccggcatctgctgcgcgccgccgctcgccaatcccagcacgcgtttgccgcgcacatcgccgacccactcatgcggcaccggtttcgtgggcgtgagcagaatgttccagctgccgtgctgcgcatccacgaatgcgtcatgcgagatcggcactccccactgccaaccctcgtcaacccagcggtctattgtctgcgcattctcactttggtaatccatgtccacactgccatttcttcgcccgtcccgccgcgtgattgcacggcaggtacgcctcatcatatcgaattcgcatgcatagtgccgcagattttccacagaccacctgttcctcggtcggattcacggtaacttccgtgtaaacgaccaccgcagcctccctctacggcatatctcacggaagcttccgagaaaccgaccaccgcaggagctctctacagcacggctttcggaagcgtccgcaagaacgaccacaaacaacctccactgcagtcaaacgcacggaggcttccgcaaaatctgccatcaccgcacccagaaacggcacggcttacggacgcctccgtgaaaacggcactcactccacgcagggcttgagatagcggccggtcacgctgagcggattctcagcaatctgcacaggcgtaccggtggcgacgatctcaccgccgttctcgccgccgcctgggcccatgtcgatgatccagtcggcgttcgcaatcatgtcgaggtcgtgttcgatcacgaccacgctcgcaccgtggtcgatgagcttctggaacacgccgatcaacgtgcgcacgtcaagcggatgcaagccaatcgtcggctcgtcgaacacgaacagcgtgccatcctgcgcgcggcccatctcgctggcgagtttgagccgctgcgcttcgccgcccgagagcgccggcgtgctctcgcccaacgtcaggtacccgatgccgagctcgtgcaatgtctcgagttcggcatgcaggcgccgctgcccggtaccggtgaagatgtcgagcgcctcgtccaccgtcatcgcgagcagatccggcagcgacaccggcttgtgcccgttcttcggcgtccaggtgatctcgcctgcgacatcgccgtagcgtgtgccgtggcagtccgggcagtcgatgtccacgtcgggcaggaactgcacgtcgagtgtgatctgcccggtgccatcgcaggtagggcagcgcagcgagccggtgttgtacgagaacgcgcccgccttgagtccacgcgccttcgccgcatcggtgcgcgcatagagccgccgcaaatcgtcgagcacaccgctgtaggtggcgacggtggagcgcacgttcgcaccgatcggcgtcgcgtcgatcatcgtgacgcggtcgattcccggcgcatcgagcgcgcgcacatgttcaggcaggcgttcgccggcaatcttcgcagtgagcgcgggcacaaggctttcgagcacgagcgtggtcttgccggaaccggagacgccggtgaccacggtgagacgatgttttggcacgcgcgcatccaaggcgtgcacggtgtgcagcggcgcggtcttgatttccagtgcgccttcgtcgaataccttgttcgcgggcgtttgcgggcgcacgatctgcaaacgctcgctcgcaaggaacggagcgatgagcgagtgcgggttgccttcgatgtcactcaccgtaccctgcgcgatcacagtgccgccatgtgatcccgcgcccgggcccatttcgatgatccagtcggtgtcgcgcagcacgcgggtgtcatggtcgacgacgaccacagtgtttccctgcgctttcaaatcgcgcatcacgccgagcagaccgtccacattcgccggatgcaagccgatcgacggctcgtcgagcacgtacatcgcgccggtgagctcactgcgcaccgctcgcgcgagctggatgcgctggcgttcgccggtcgacagcgtggagcccgcacggtcgagcgtgagatagccgagtccgagttcgagcagacgccgtgcggtgcgcgtgaactcgtcgacgattgactgcgccatctcatgcatatcatctggcatcgtggcgggtacggtccgcacccactgcgcgagattgtcgagctgcatcgcacactgctcgggcaacgtcttgccatccaccggcagtatgcgtgcgcgtttgttgagtcgcgtgccgtggcagtccgggcatggctcctcggtgatgaacggttccacgcgtttcagcgccttggcgtccttggctttgtcgagcgcgttgagcacggtgcgttcggcgctgaaataggtgaagtcgagctcgccggcacggttctctttcttcgaatggtagataatatgccgtttctcggccggtccgtggagcacaatctccttctcatgcgcggtcagatccttgtacggcacgtcagtgcgcacgcccatttcgcggcatacgtcgaccatgattgaccacatgagcgaacgccagggcgccacagcgccttgttctatcgtcagattcgggtccgcaatcaacgttgcctggttcaccgtgcgcacgatgccggttcccgagcacgtcgggcacgcgccgcccgagttgaatgcgaggtcctccgcaccgagcgcctgcacttcctccccgcacaccgggcagatgatcggccgttcgagcgcgacgttcggtgtcgggtcgagcatatggccgttcgggcaggtataattgccgagccgcgaggtcataagccgcagactgttgagcagctcgctcatcgtgccgaaggtgctgcgtatacccggcacgctcggccgctgatgcaacgcgagcgcgggcggcacatgctcgatcgcgtcgagtttcgcctcgccgctttgcgagatgcggcggcgcgtgtatgtggagagcccttccaggtagcggcgcgagccttctgcgtaaagcacgccgagcgcgagcgatgatttgcccgaaccggagactcccgccaccgccaccatcttgccaattggcacccgcacatccacgcgcttgagattatgcacacgagcgccggtgatatcgatggtctgtgccatgccgccacttccttacgcattcgccgtcttcatattcgctactgccgagcgtaaagcccgcgcgtgcactccgccgtgggcgcactgagcgcgccatctccactccgcgacgagtaatcgggcacggtgcattgcccgccatgcagccacaggatgacggggttacgccggtcttcgcctcgaatctgcacatactgctcgatgccgcccaaggtgacgtgcgtgtgttcctgcaccccatgcgcagttgtgatgcgtatggaagcaaccctgcgaatgctgccacatggtgccttggttggcgatatgcggttatagacgttcacgcgccccgcgagcgcttgtggtgtgcagcgcgtgcccactatcccaatccatcattccgtgctgaaatcagacttcacaacccatcattccgtgtcaaaatcagcttttggaacccgccattccgtttcacacatcgtccgggaaggcctgtgcggccttggaaagaaacgatgtcgggattgcggatatgcatgcgtgggcatcggcgttgcacaccgcggcgagaaggcgctacgcggtacacacagcgaaacgcaacagctcgaacgcttgaacattcttgacaaaaacggtcatgtgcgtctcgctggactactcatcgcaggcgtatatccacagcagttcttccctcggttgtatgtggatgtcgctgttcatccgggcatcagcaaatctcaagatgacgaagtccgcttcctcgatcgcgtgcagtgccatggtcgactgcaggaaatggtcgatgacgcggtcaaagccgtcctgcgcaatctgcgtacctattccctcacgaggggaacggaaggcgcgatgtaccggagattccaactgtggtactacgcgaggcaatcgccaatgccgtggtacacagggaatacgacacattgtttcgcaacgacccggtgaatattgacgtgtactccgatcgtgtggagatttcgagccccggcaatctgtggggcggcaagacactgcagaatctgaccaatggtgtatcccggtgccgcaataccacgttgatgcaactgctacagaagacgccgttgattcgcggcgatcacgatggatccgccgtggaaggccaaggttcgggcatccagttcatgatcaaccgaatgaaggaactatcactcgcacagccggatttccatccgaccttcgatcgcttccgtgtgattctgtatcgtggtggcgccgagattgctgcaaaccagcagtgggtgcgaagccatgtggggcacgacctgccgggacgcgaaagttcagtgctgtacacggtgcgcgcgcttggccgcgcaagtgtctacgacatccgagaccggctcggatatgattcagacgacatccgtgcgatattggccacgctggtggaatccgggctcatcagacaggtggctaccgacatatatgaacctccggagacaccggccatcaccaatgccagcgatgccccagcgcctccagcagcagcgccatcgagccgacaagccatcatcgacacgatccccacgttcggcacaatcagcgcacgcgacatcgcggaggcgacaggcaaaagcctgcagacagtgcaccgcattctgcgcgagctcgtggatgaaggtgtcatcaccgcaatcggcaaaaagcagagccgtctgcgcacctacacacgcaaacagaccatcgactgactgcatctcgcgcacgagggtagatcagccgtgaaaccgcgacacttcgaagatggtgcatcggctgagttcgcgacgcatcgccacccaattcggcaaagcgtcagtcatgcgcgcctatttctcgacggtctcatggtagaagaaaatgaccagcaccggcgcagcatcgaaaggacgtcacataacagtatcggcagtgttctgctcgaccagccgttccgcgggatcggcatggtatgcgtacccctgtgcgcatacggtagggtgctacggtgtcttcaaaatatagtggcgtatcggatcgcataatgaaggggcgtcacgacacgccgagatgttcacataaatgttcgtttaacttaaaaacagaacatcgtaagtgttcgttttgagtatcgacagaacacgacaattcacaaatcaacagaacagaccaattcggcagagataatatgcaattatgacaaaaccctctgttatcaacgattattacagtattggcatgctatactagcacatggataccaattgtgagcaataacacaattgatgttcatactgaaaaacatatcattaacagacacataatcaaacatatgaaatgtttgatttgcagattatgcaaggaacccccatggcagaagcaacgaagcacaccatcaccgtcgacctcgacatgttcgacaagacaccggaagagaagaccgcacacgcgaacgagatcgcacgggagttcggagtcggcgaagacgcgttggccgccgtggaagacttcaagaaggaactcaccaagcacaacgcgtgggatctgccgttcatggggtacgtgaacgaggatggctacgggtacgcatacgtgcccaacgcggcgattacgaccaccccgtactgggatgcacatgcggcgtttctcgcattgccgaaggacgcgcagaccgcgttcgcgatccgtatgctgttcacacaccgccccgtcgaccgctatggcgcagacatgttcctgcactaccagcgcggcatcagcacgaacttcatcggcacgggagcgaataagtactgaccgacgctcggccatgcggacgcatcagccgcgcgactgcggcacatcgaagatcgtgcagcggttgagttcgcgccgcagttccttccagtttggcaacacgaggctcatgcgctcctgaaacgtccgcccgtgcccgctctcccacagatgagtgagttcatgcacgagtacatactcaagaaactgcggatccatgagtccgagttgtagattgagcctgatccgccccgttttcggcgtgcacgaaccccatcgcgatgtcatggtgcgcagagtgatttttgtcggagatttgccgacgatcggcgtccacttgctcagcaaatcgggcagttgctgttcgatcgaacggcgggcacgctccacatactcctcgttccacgtgaaactactggtctcatgcggtgtttccatccggggcgaacctgggtcgcgcgcatcacgcaacaccgtcgtgcgactgccgccgacgtcggggtcgaggtcgggcgatgcgaacgtccgtgaacgagcctgtgccattttatgcagcgcttcgtcgacccaggaacggcgttcgcgcacgaactccacgattgtgtgctgcggcatgcgtacgggggccgtgacctcgatcgccccatatggcggtttcacgcgcaagtacatgttgcggttcttcttgcgcagcacattgacctgcagtccgtcgacattgagcacttcgcgggcgcgcgtggaacggtcgaactgagcacgccgtgaaatggaacgagcgcgagggacggaattgaatggcatgaccatattctgtgcaactattcagacaaatgttcgaatgaatcacccacctgggaattgtgcgacacgccgaacgagcgtcgatttgcattaatcgagaagcacaggtattctttctatctgttgcgttgaacaacgtgatggattgggcccgtagctcaggtggttagagcgcatccctgataaggatgaggtcggaggttcaagtcctcccgggcccacgtggggagcattctcacgtgttcccccgttggggctatagcgcagctggtagcgcatctgctttgcaagcagagggtccccggttcgaacccgggtagctccactcgcatggtcgttgaaaacattaggttttcaacggtttttctttttgcattctatcttccacacacatcagagcaaacaacaaaacaacgcagctggtttcggtatctgccagacatgcaaatctgcacaccggcaaagaacgatattttgcagactatggtcggttactgcacatacatacaacagaacgaccataatcacggcaagtatggtcgattaccatacatctgcgtcagcaaacgaccatagttctccgcagtatggtcgattaccgcatccccgcataacaaaccgaccataatcaagaaaaagacggtcttgtaacgcacgcgcacatcgcggaacagacggggcgtggtgcggcgttcgatgtcgcattcgaacagcggggagctcgcgccggatggaatgcgcaggttgtcttcgccacggcagattttacggaagcttccgcataacagtccgcagatcatcgccactgtggcccgtttcacggaagattccgaaaaacaagccgcaaaccactatcatcacggtctatctcacggaaccatccgcaaaacagactgcaaaccgcccccaccacggcccatcccacggaagcatccgagcaaatgaccacagacgctgcaacacaaaaggcgcccggtacaaccgagcgcctttcagcgatgtcagaatggatatcggaatgtcagatcactgcgatgcccatgcccatacgcgcatcacttggattccggtgcggcagtggtatccgtggcaaccggtgcagcatgagcaccggcgggctgctgggcggcgagcgcattgcggatgtcctgcagcaggatcacggtctgttcctccggcgagagatccggttcctcggcggccacgtcggaatcgtcgcccttgaccttggccatggccttctccgtcatgtcacgcagattgttgatcggcacgacgatgcagaagtacacagcgagtgcgatgagcaggaagttgaggagcgcgttgagcacggagccgaacgagatcaccgagttctcccccgcccagttggtgatggtccaattccaggtcttgctcaaatccggcttgccgaagatggctgcaacgagtgggttgatgatgccatccaccacagagttcaccactgcagtgaccgctgcgcccatgacgacgccgactgccatgtcgaccatattgccgcgtgcaatgaatttcttgaacccgtcgatcatatctctctccttgttcagacggtaccactggctccgaggcctagcagctcacgggacccaacgggaatatgttcagttgccataatatgtggacacgggaaaaagcttggcgaatttcactctcgcgatattcacgccgcactttttcctacaggtgaccagatacgacaggtcggcgcacgcgcatatgcatgcacgccgacctgatatggctatatgccgttattcagttagatgtcattggagactactgctgatggcgctgccgagcccagacgagcgtcgcggcacccgcaagcacaagggccacggcgatggctgcgaccacggcaatcgaggagccggtgttcaccaccgacttgttttcgtctgccttggcgttcgactgctgggcattgtcaccagactgagcattgtcaccagactgagcattgtcacctgccgccggcttgttcgcatccgcaggcttgtcagttccagcaggcttgtcggtgtcggtgggctggtccggatcagacggatcagacggatcctcagtgtcctgctgagtgaagtcgatcgggcaggtggccggatcgccagctgccatatcggccgaatagtcgggggtctcctccggctcggtcggttcggtaggctcagacggttcctcaggcttggtctccggcttcgagtcggaggcgtcgccggaaggaacgaccttcaggtcatcgacggcgaagttcacagccggggaatctttgttccaagtgttgcctgcaatcacaacctccttgaagagtgcaaggtcatcggcggtcatcgtcttgcctttgttctcatcctccggccagctctgcgtcagcgacggattgttcacaagatcgatctcgaccgtcttccaatcggcgccatcctccgaagccagcttctggtcgacatggaagtacttgccgtcggcggtgccgatctgcaggtccatcgcattgttcgaaccatcgtgcttcagacggaacgtcagcttacccaaaccggtccagttgttgcgggccgtgtcgttctggatgaacgtcgcgacatcgagccagccaccgtgcgggttcgagtactgcaggtacttgttgtcgtcatcctcggttgtcagcgagagcacatccgtgtgttcacggttgccccaagcctccttcatcgcagcctcatcggcatacgattcgaagtcgtcgatcgtgatcagcttggcgttggacggctcggaagacttctcctccggcacatacggatcgcgttcgccgacgagcttgatcgaatcgaacacgaggtcgccggtacgcggacggccggcgttgttctgcagctcgttgtcgttgtcgttcacatagatggcgaaggagccgactttcgagagcagcttctgattaggcagcttaccggcactgtccttgtcccagctagccacgttccacacgcccggcttgtctcacctgcgcatccttgcccttgagcgacggataggcctcgaaggtgactccgttggcgttcatctggatcacaagcttgtgatcggagccgttcgccttgcgcgcgccgcacaccgcggcacccacgccacaactagactgaaaccgaaacagaggtgatcatgacagccggcaacaacacacaccgcaagacaagcagcgccaccgacagtgccaccgacagcacgcagcggcaatccaatcccagcggctacaccacgagcgccggcgagcgcgcggccggcaaagccagggagcggctcatcacccgcgatgtggcactcatcatggcggccacgttcttctatatgacaagcagcatgatgggcacgccaatcatcgccggcttctcgcaatcgctcggtgcaagcggcgcactcatgggcttcctcgccggcgcactctcgctcagcgcgctcatctgccgaccgattgccggcaatctttccgaccgcacgagcaaacgcaagctcgcggtgatcggcgcgctcatattcctggcgtcgaatctggggtattacttcgtgccgaacaccgcatggctgctggccgcgcgcatactcaacggcgtcggattcgcctgcatctcggtatgcctgtccacatggctctccatgctgctgcccatctcgcgcatgggcgcggggatggggctctacggcacgatgaacgccctcgcgcaggcggtcggccccgatctgggcatccgcgcgtcgaaagcaatcggctaccgcaacacctttctgatcgccgtgggtctcacctgctgcatagtcatctgcgtactgctcatcaaagacggcggcaagccaccgcgtgcgagactcggccggcagcaaggcggcgagcgtcaccatattcgcctcgactcgctgttcgagccgcgcgtgattcccatcgcactgatcttcatgctgttcgcgataccgtatttcgcgaaccagtcgttcatcgtggattacgccaacgcacggcacgcccatgtgatcgtctcgctgttcttcccgtgctatgccatcacgttgctcatctcgcgcatcgtgttgcgcaactggtttgacacgaagagtttcctgttcttcatggtcaccggaacaatctgccagattgtcatgctcgcctcgctcaccgtgatgcgcaacaactggttcgtcatgctcgccggactcgccacggtgggcgcatacggcatgatgagctcggtcacgcaggcgcgcgccgtgctcatcgccggcaaggcacgcagcggcatggcgaacacgacatactatgcgggcatcgatctgggcatgttcctcggcccgctcatcggcggcttcctgtacggcggattgccaatcatctggttctaccccgcgttgttgctcacgatgccagtcgcatggattgtgtacgccttcgcacaccgcaccattcaaagcagcgagcgcgcgccgcgtatctgagaccggcacagcgcgcgcctgccgatatccaataattgaaaaacactcttcacatatatggacgcgctccttacaatgagggaggtttattcgccaacacgaaagaggaataatgctcacagatgagtatgtgaagcgcgtgtatgcgcaggtcgaagcgcgtgatccggaccagtccgagtttctgcaggccgtgcaggaggtcttcgaaagcattgagccggtgttcgccaagcacccggagtacgaggcggccggcgtgctgcagcgtttcgtggagcccgagcgcctcgtgaagttccgcgtggcctgggcggacgacaacggtgacgtgcaggtcaaccgcggctaccgtgtgcagttcaattcggcgatcggcccgtacaagggcggtctgcgcttccaccccaccgtcaccgagagcgtcatcaagttcctcggtttcgagcagattctcaagaactccctcaccggcctgcccatgggcggcggcaagggtggctcggacttcgatccgaagggccgctccgacgccgaggtcatgcgcttctgccaggcattcatgaccgaattgcagcgccacatcggccagtttaccgatgttccggcgggcgacattaacgtcggcgcacgcgaggtgggctatctgttcggccagtataagcgcctgcgcaacgagttcgccggcgtgctcaccggcaagggactcgaattcggcggctcgctcgctcgcaccgaggccaccggttacggcctgtgctactacacgcaggaggcgctgcgcgtgctgcgcgacgactcgttcgaaggcaagaccgtggtggtctccggctcgggcaatgtggcgatcttcgccattgagaaggccacgcagctcggcgccaaggtggtcacctgctccgattcgaacggctatgtctatgacccgaacggcatcgatctcgatgtggtcaaagacatcaagctgaacaagcgcggccgtattcgcgaatatgccgaccgtgtcgacggcgcggaataccacgaaggttgccgcgaggtgtggaccgtgccgtgcgacatcgcgctgccgtgtgcaacgcagaacgagatcgacggcgaatctgcccagaagctcgtcgacaacggctgcacggtggtctgcgagggcgccaacatgccgtccacgccacaggccattgaggtctaccagaagaaccatgtgctctatggcccggccaaggcagcgaatgcaggcggtgtggcggtctccggtctcgagatgagccagaactcctaccgtctctcctggagcttcgagaaggtggacgaggaactcaagggcatcatgaagaacatcgtcgccgaatcgctcgatgccgccaaggaatacggacacgacggcgacctcatgttcggcgccaacgtcgcgggcttcaccaaagtggcgaacgcgatggtcgcgcagggcatcttctaagcgcccaggggcgccctcggcgtcttcgctgcgtaaaaagggacagattagctcactaatctgtccctttttacgcagcgaaggaggagaaggaggagtgcaatctcataatcggggtgcagttcagagtgcaaccaacgcaaacccgagcctgcgtaaaaagagacagatacaccgcataacctgtcccaaattacgcagaaagggagccgtacgcagaaggagagctgtacacaggaaataagcagcacagccccacgccaccttccgcgatggctgccctcacctgcgtaaaaagagacaaatcgggtatggaatctgtccccttttacgcaagaatgctgcatgcaatttcctgtaggaataactcaggcggccgttttatacaaaacttcctatgctgggcaatatggcaaacaggagagcgaatcccagtcagcgcaagcccccgcgcagttcgtacctcgaagattcccgtatgaagcgcaacaaccggcatattggccaggtcacgcgttctcagaaaccacgcaaagtggtgacggcgaagaaactccgcgcgcagagcaagcgcaacgagcagtaccgcaccaagatgcagctcaggcagatccttctggaaaaaccgaagctgcgcggatggctgcatctcatcgccttcccgttctccgtggccacctcggtgatcctcatctgcctggcgccgagcggctggatgaaggtggcgatcagcgtgtacagcgcgacgatcatcctgctgttcggcaacagcgcggcgctccacctcggccacgggtattttccgaaggccgtcgacgacgtactatgccgcatcgactattcgaacatcttcctggtgatcgccggcacttgcacgccgttcttcttcgcactgaacaacacggtgatctgctgggtgtatgtgggcgtggtctgggtcaccgcattgcttggcacgttcgtgcatctgatctacccggtgggcctcgactggctgttcaccatcgtctacattgtgctcggactcgccccgatcacaatcatctggctgttctggaaatccccgtacatcgggcctgtgcccaccattctcgtgatcgccggcggagcctgctatattgccggcgctgtatgcttcgcgttgcgcaagccgaatccgttcccgaagtggttcgggttccacgagctcttccatttgggtaccattggcggctatgtgtgccatgtgatcgcactgttcatggtggtgctgcgcatgcgcgcgctcatgtaaccgttcgtatgcagcaattcggctgccgggattcgtgtgttccggtggccgtctcgctgtatgccatgtctgcggattattcatcgctgcagattcggttccggcagcgtggaaacctgcggctgtggcgaagtgggcggcgtctgcggatcggtccccggcacgagatcccacggcatgcacttcttgacaagccagaagatgagcagcgcaagcaacgtccatccccagatcgggtggttcgtggcgagaccgccgaatatgacgccgaagaacagcgtgcggattgcgtagaacgcaatgcgctggccccgtgagcgatcacgcgtctcgatggtcatgtgggtgtagcggcaaccgagcgtctggccatggtgacgccagggaatccacacctcgaacagcaggaacgagagggccgcggtgatccacgtcatgtagtcgagcacgcgcggttccacggtgagcgacagccagacgtaatggccgtctccggtcgatttgaacaccaggtagaacaggaagatgtacaggatgctcagtggcacgtacaccagcgcgatgagcaggaagtcgatgcacatggagaccatgcggtgcacgaatcccggtcgcgtgttcgtgccggtgagctgcttcgctttcttcggcacgagtttcgtgtagagcagggcgcacgcatacccgagcatcgcaccgagcgtgttcgtgagcatgtcgtcgacgtcgaactggcggtacgcgcacgggtagatgccccagattccagtgagctgcgaggtctcaatgaatatggagcagccgagtgcgaaggcggaggtgacccagaatctccagccggcccaacggcacagcatgaagccgagtggcatgaacagcacgacgttcatcacgagttgcagcacgccgtacaggccggtctgcgcatcctgaatgaaccgcagaatgtcgagctgcggggcgaggttgtgcgtggcgcagaagagcgtggggtcgtcgggcatcgggtacatggtgaaggccacgaggccgagtgcatacagcaccgccacgtatgcggagaacgcgctggtgaagctcagccggtggttgcggtggtagacgaacgccacaatcggcagtgtgagcagcaacgacacgaatggccacagcatgagtgccagcgtgaacgattggctgaacgaccctagatacctaaacacagtgttgagtgtagcccagccgcatgcccgtcgtactcattcacaggaatgatttgcgtgcggcaggcagcgcgatgtgggtcatcacaggcgcagcgaaggcgcgaccaatgaaaaagcccctccgaggaggggccgaagcggaacgaaggggatcagtcgtcgccgagcgtgacgtgcacaccgccgacgagcgcgctgaccacgttgtagagcaacgcgaagatcgtgcacaggatggtgatgatcaccatctcgacgatggagaagatcgtcaccgcactgagcacggtcggcaacgaaaggatgttcgacagattgatgctgcccgagtcgagaccggcggacgagaagatctgcgtcacctggtcgaatacaccgaccgccttgagcagcagccacaggaacagcacggcgatgatctggatgatggcaccggcgagtgagagcatgaagctcaccttggccaccgaccatgcgctcacacgggtgagcgagaggttcatgcggcgggcgtgtggcttcttgcgattgcggatcgggcgtaccggtcggttctcctcagggcgatccctgtcggcgatcagtggcgtgttcgaggccgagcgtgccactcgcggagcgttgtcagcggcagacgatgcggccgcacgaggctgttggccgggttcaagcggattggtgttgctcataatcgctccttgaaaagaatatacggttcgagagtatcaatgtttcaagaccttgcaccggaagccacgcatatgggcgggatctgccgaataccgcggtatgtccggcagatcccgtgcgacgctcactcttctcggctctcttccttggtcttgtcgatggccgcggattcctcttcgatcatcggcatgccgttttcggacttcacctcgaacaccggctcgccctgtgcgggttgtgttgcggtggcctcggccgaggattcggtgacgacggtgtcgccgtccgcctcatcttcggtctcggcattgcgtgcaatcgagatgatctcgtcgccggcatccggcttcgcgagcgtgacgccctgcgtggtgcggccggtgagtttgacctcgctcacattcgagcggatcaccttgccggatttcatgattgccatgatctggtcttcctcgctcacgacgaccgcgccgacgagcgtgccgcgttcgtcggtgagctgcacggccttgacgccgaagccgttgcggccctgcaggcggtattcgctgatcgcggtgcgcttggcgaagccctggttcgtgacgacgagcaggtccttgtcggtctcgccccagatcacatccatcgcaagcagttcgtcgcccgcgcggaacttcatgccctgcacgccggcggtctggcggcccatcggtcgcagctgctcgtcgtcagcgcggaacttcaggctcatgccgagcttcgacacgagaatgatgtcgtcggtcgcattgcacaacgcggcgccgatgagctcgtcggcggtctcgccggattcgtcctgcatcagccgcacggcgatcagaccgccctgacgcggcgaatcgtattcggaaaggcgcgtcttcttcaccttgcccgagcgcgtggcgagcacaaggtaatcggccacctcgtagtccgggatcgacagcacggtctggatcgactcgtcgggcgtgaactgcagcagattcgccacatgctgccccttggagtcacgggagccttcgggaagctcgtaggccttgcaacggtagacgcggcccttgttcgtgaagaacagcagccagttgtgcgtgctggtgaggaagaagtggtccaccacgtcgtcgtcgcgcagcttggcgcccttgatgcccttgccgccgcggtgctgggcgcggtattcgtcggccttcgtgcgcttgatgaagccggcgtgggtcaccgtgaccaccacgttctcctcggcaatgaggtcttccacgttcatttcgccggagaatggcaggatcttcgtgcggcggtcgtcgccgtagcgggccacgatctcgtcgagttcgtcgccgacgatcttgcgctggcgttcgggcttggcgagaatgtcggcatagtcagcgatccggcgcatgagctcatcgtgctcgtcgaggatcttctggcgttcgagtgcggcgaggcggcgcagctgcatggcgaggattgcgtcggcctgcacatcgtccacgcccagcagatccatgagcccggtgcgggcaatctccacggtctgcgaggagcggatgaggtggatcacctcgtcgatcatgtcgagggccttgagatagccctgcagaatgtgatcgcgttcctcggcctctcgcttgaggtatgcggtgcggcgggcgatcacgtcgagctggtgggagacccagtggcgaatgaatgcgtcgaggctcagcgtgcgcggcacgccgtcgacgagcgcgagcatgttcgcaccgaaggtctgctggagctgggagtgcttgtacaggttgttgagcaccaccttcggcacggcgtcgcgcttgagtacgagcacgaggcgctggccggtgcggcccgaggtctcgtcgcgcatgtcggcgatgccggtgatcttgccgtcgcgcacggcctcgcgaatcgaggcgacgaggcggtccgggttcacctggtacggcagctcggtgacgaccaggcacatacggcccttgatctcctcggtgttgaccaccgcacgcatcgtgatgaggccacggccggtgcggtaagcctgttcgatgcccttgtggccgagaatcgtcgcgcctgtagggaagtccgggcccttgatgcgttcgatcagggcgtcgagcagctcctcgcggctggcctcggggtggtcgagcgcccaatgcacgccatctgccacctcgcgcatgttgtgcggagggatattcgtggccatgcccacggcgatgcccgaggagccgttgacgagcagattcgggaagcgggcgggcagcacggtgggctcctgcgtcttgccgtcgtagttcggcacgaagtccacggtatctttatcgatgtcgcgcaccatttccatggcgagcggcgccatacggcattcggtgtaacgcatggcggccgccgggtcgtcgcccggggagccgaagttgccctggccgtcgacgagcaggtagcgcatcgaccacgactgggccatacgcaccaaggtgtcgtagatggcggagtcgccgtgcgggtggtacttgcccatcacgtcgcccacgacgcgcgagcacttgttgtagccgcggtccgggcggtagccgccgtcgtacatcgcatagaccacacggcggtgcaccggcttcatgccatcgcggacgtcgggcaatgctcgctccacaatgacggagagggcgtaggagaggtacgactgccgcatctcgtcctgcaaatcgatcggctgcacgcgctggcccaccatgaggccgtagtcggtgttgtcggcctcctgcgggctgagcggctccagggagccgtccggcagatgctgttcgtcgccggagtcgttgacagggccgttgtcgaggccgttgttggttggttcgtctgccacttgaaatcctttaccttgctgttgctacgtctacacacgccacggcccgtcgccgtgggcggcccatatcaggcgtcgatccagcgggcgttgtgtgcgttgcgctggatgaacagacggcggggctccacctcgtcgcccatgagcatggagaacgtttcgtcggcctgcagggcatcttcgatatgcacctgcttcagaatgcggtggtccggatccatggtggtctcccacagctcctggtagctcatctcgcccagacccttgtagcgctgaatgccctcgcccttcggcagctggcgtccgttcgccttgccttcggcaagcacgcggtcgcgttcggcgtccgtgtacacgaagtcgtgcgggcccttcgtccacttgagacggtagagcggcggcatggccacatacacgtagccggccgtgatcatggggcgcatgtagcggaagaacagcgtgaggttgagcgtggcgatatgggcgccgtcgacgtctgcatcggccatgatgatcaccttgtggtaccgcaccttgtcgaggtcgaagtcctcgccgtatccgccgccgatcgccgtgatcagcgactcgatcgtgtcggacttcagcatgcggtcgaggctggcgcgctcggtgttgagaatcttgcctcgcagcggcagaatcgcctgcgtcagcgggttgcgaccctgaatggccgagccgcctgccgagtcgccctcgacaatgaacagctcgcactcgctcgggtcgttcgactggcagtccttgagcttgtcgggcatgccggcggactcgaagatcgacttgcggcgggtgttctcgcgtgccttcttcgcggccaagcgggcgcgcgatgcctcgagcgccttctggatgatgttcttcgcctcgttcggatgggcgtcgagccagtcgccgagtttctcgttcatcacgcgctgtacgaaggtcttcgcctcggagttgccgagcttcgtcttcgtctggccttcgaactgcgggttcgtcagcttcaccgagatcaccgcggtcaggccttcacgcacatcgtcaccggagagattgtcgtctttgtctttgaggatgttcttgtcgcgggcataccggttgatcatgctcgtgagcgccgcgcggaagccctcctcatgggtgccgccctcggtggtggcgatcgtgttcgcgaaggtgtgcacggattccgaatatgccgacgtccactgcatggcgatctccgcggaaacacctatggtgaggtcctcggactcgatgtcgatcacatccggctcgatcggcgcggaaccacgcgacttcaccaggaacgccacgtagtccttgatgccgttcttgtattggtacgtgacggtctggtgcagctcctccaccgtgttgtcgccgtcgccggccacttcgtcgcgcgcctcgtcgacctggcgcatgtcggtgagcgtgatcttgagtcccttgttcaggaacgccatctgctggaatctgctgcgcagggtctcgaaatcgtagattgtcgtctcgaagatcttcgggtctgcccagaacgtgaccgacgtgccggtggactcgtcgtcgcgcatcgcacgtccgcgctcgagcgggccggtgggatgctggtcgatgtacgtctgcgtccagtagtagccctgtcggcgcacttcgacgtccacgcgcgtggagagcgcgttcaccaccgagatgcccacgccgtgcagaccgccggacaccgcataaccgccgccgccgaacttgccgccggcgtgcagcttcgtcatgacggtctcgacgccggacttgccttcgccgggcacttcgtcgaccggaatgccccggccgtcgtcgaccacgcgaatgccgttgtcgggcaggatcgtcacctcgatgtgcgtggcatacccggccagcgcctcgtcaaccgagttgtcgacgatctcatagaccaggtggtgcaggcctcgcggaccggtggaaccgatgtacatgccagggcgaatgcgcacggcctcaagcccttcgagcacgcgcaggtcgctcgcgtcgtaatgctcgggagacagggtgtcgtccaactgttcgtcgttctggtccgtgccgttggcttcaaggttctgatcgatcggatcgttgctcgccgactcaagcgactccgctgcggaatcggttggttgatctgccacagagattcctttctgtgaatgcgctacgaagggttctcacacaggcgatatgccctgtaacacgaataaaacgcccttgtgggcgttcaactacactactaaggattctactcgcatggggggactcgtgttcttagcgcgcttgtagcggatttcctggtttttcgccgcacaagcggtccgagttggatcactgtggacggtagtgcatgttctgccgcacatattgcttgcgacgcgtggcgggcccatgcgcctgcgggcctgtgacgcgaatgtcgcggatgtcgaggccattgaggcgctcgagcaccttctcgcgcagctcgggcagcatgaacgtgagctgcgtggtccacgacggcgacttcgcgtggatggtgagcacaccgttgtcgatggcgcccacccaggtgttgcgtgcgatcacatcgcccacgatcgacgcccaatcgtgacgcaattgggccagtttcatatggggcacccagccggcccgtttggcgatccccgcgaacaacgagccgaacgccacctcgtcgcgccccggtttgccgaagttctcgagcgcctcctcgcgcttcacgcgccgttccgcaatgagtccggcgcgtgccgagacatgttcgaactcctcggccggcaatgccctctcatcgagcttcaacgtcactgctatgggtggctcgctcatgcgtgtgcactttcatgtttcgtcagaccaatttcacgctcacccgaaacctgttctgccgattggtctgcagattgttcgaccttatgtttgccatcactgcctgcatgcatgccagcggttcgccgggaggcttgcacggcggccagctgaccggcgaaggggtcgtcggccggcagtggctccggcatgaaagcggtgccttcgccgccactcccctgcagcttcaatgccgccacatcgatcacatgggcatgggcgtcgccaggcagttccggcacgtcgccggccgccgcaacggtgatgatcacctggtcctgcctcaacgcgaattccatgattttcgcacgacgtgacgggtccagctgcgcgaacacatcgtcgagcaccacgatgggccgttcccccgccttgcgttccagaagacggtagagggccattttcaaggccagcgccagcgtccagctttctccgttcgacgagtattcgcgtgccggcatgccgttgagctcaatcgagacgtcgtcacgctggggtccgatcagattcaccccacgcgccacctcccccgtgtagatgcgctggaaatgctcgctgatcgccgccttcacccgctcgggaccgccttgctcccctgcctcggccccttgggtgaggtatagctcgtcgaacgacggctcatacacgagcgtcgccgtttgatcgacatcacttaattcctgtacgattgttccgaaatattcgttgagcatgccgatgactgccatgcgctgtcgggtgagttccagaccggtttcaatgaactgtgcggtccacacctccaagccgttcatgcgcatctggcgcgcctcctcggacaccgagacgccctcctgcgcaccgatttgcttgagtagcgccgcgcgttgcttggcgatatgcgtgaagcgttgcaacaggtcggtatagccgcgaaccagcacgctggcggcctgatcgatgaacgaacggcgcacggcagggtcgccccacaccagacgctggtcgtcgggagtgaatgcgacgaggggcacgcgccccacaatgtctcgcatatacaggctcggaccgccgtccacgcgggcacggttggctccccgcacccgaatcgtcagctcgaaggtggtcgtccggtcatctattgtctcggtgttgttttcgaaatcttccgatagttcttctatattcgcgcgaatggcggctgcggggaacccttgctcgacgagtggctgagacgttgaggcgcgatggctggagccggtggacagcacctcgagcgcctcgacgatgttcgttttgccgagtccattcgggccttccagaatgttgacacccggtttgaaatccagcacgcaattcgtccaggaacggaagtggtcaagcgccagccgagatacggtgatcatgccacttccttcctgaacttgaaatcaatgctgcatcactgcgaatcagacgttgaaacgcatcggcacgagcaggtatcgatagctcatcgactcctcgccatcctcatcctgctgcccgttgaattccaccggcttcacggcggtcgtcatcttcatgcgaatatacggttcggagatcacgctcagtccttcgcgcagataggacgggttgaatgccaccgtgatgtcttcgccatcgaggtcgatctgcagcgtctccttcgccgaggcctcatcggcgccgccggccgtgagtgtgagctgttggtcggtgaacaccatgcggatcggggcgttgcgttcggccaccagcgagacgcgcttggcagcgccgagcagatcttccttgcgaataaccgcttgaatcgggtaggaatcggcatacaaccggtcgacggcggggaattcgccatcgatgagctgcacggtggaaatacgcccggcgttcgcgatgccgatcagcttcggattagcggggtcgaggtagatgaccacgttcgcacgctcgtcaacggaacgggcgatcttcaccaagtgggaaccgcgcacgagcgccgcagtgtcaagatcggcctcgtcgggggtccagcggaagctggcacggcccagacggaagcggtccgtggaactcagcgtcacctcttcgccggcgaagcgcatgtgcacgccggtcagcaccgggcggttctcgtcatgggccacggcgacagcggcctgggtgacggtctgcgtgaaggtttcggcgtccacctggccaatctgcggaggcagctgcggcagatccgggtactcgctctccggcatgagctgcagcgtgaacgtggccgggccggaggtgatggtcattgtcgtctcgttggccgaaagataggttttctcggcaggcagcaccttgctgatgtccgcgagcagcttgccgagcaccacgacggtgccggattcgtcaacacccgcttcgatgtggtcgcgcgcggagatttcgtaggtgaatgcggaaagctgcatcgtgccatctgccgcctcaagtttgacaccggcgagaatcggattggcagggcgtgcgtcgatcacactcgtcgtccaagctaccgcgtctgcgaacgaagcggtgttgacttctactttcatggctctccttgctggataaaggctcggtgtgcatggcgctcgtgttccacgagctatgctcaatgcttttcattctagcgacgttcacgtcgaagggaatctgcgtgtgcaatccaccgccggatgttgatgacgacgagttttataagaaacgtaagctagtagtaatcataagtccggtggatattgtggataactgtggaaagtgcagtaaacacgggcgttatccacatgtgtgcgctgtggataaccatgggacaacatgtggataacttcgcggtttatccaccgccgtcgcaagcccggaaagttatccacaatcgctcagcccttttccacagcgggctgcggcgtttcacacatgctttccacaggcttcgcccacaaatgtggataactatgtgaataacctgttttcactcctcaccaagccgtgtgcgttgattttccgcccttttcacatacaaaggttcattgtgccgcgccgccgggactcgtgccgccgccatgcgcacagcaaaaaacgtggccggtttcccgaccacgttccgtgctgctatactcacgcgtccccagccatgcgggccagaccgcccggacgcgtcagtcgttgaggtgctgcttgagctccaccgtgagctcgttcacatagttgtagatctcctgtttctcctgcatcttgtcggcgatatgcttgcacgcatgcatgacggtggtgtggtcgcggccgccgaagatctgcccgatgttcatgaggctcatgctcgtcatgtcgcgcgtcaggtacatggcaatctgccgtgcgagcgtgacgctgcgcgggcggcccggccccacgatgtcgtcgaaggtgagatggaagtatttggcgacgcgcgcgatgatgtcggtgggcttcacctccacgtcggtggtgaagaaatcctgcagtgtgcgttcggtgagcgcacgcgtgacgggctggtggttgagagaggccatcgcgatgaccctcttgagtgcgccctcgagttctcgcacgttgttggcgaagcgttcggcgatgagattgagcacgtcgttcggcacgcgaatgtggttctgctcggcgagcatgcgcagaatcgcgatgcgcgtctccagattcggcggcttgacgtccacggtgatgccctgctcgaagcgggagatgaggcggtcctcgaaatcctccagattgtgcggcggcacgtcggaggcgatgacgatgcgcttgttcgcctggtagaggctgttgaacgtgtggaagaactgctcgagaatgccgcgtttgccgccgaggaactggatgtcgtcgatgagcagcacatccacttcgcggtacttgcggtagaacttctccatggccgggtcttcgttgtcctggccggaggtgcggatcgactcgatgaagtcgttcgtgaactcctcgctcgtcacatagagcacgcgcgggcggggcttctggttctgcacggcgtagttgcctatggcgtgcagtagatgggtcttgcccaagccagacccgccgtagatacacaacgggttgtagtcgcggcccgagccctccgccactgccagcgccaccgtgcgggcgaatcggttggaatcgccttggatgaaggtgtcgaaggtgtcgttgctgttgagatgagtcaccggatcgcggtagttgcctgtgacccccggcgtgaacgaaccctgcatctcgctttgcggcgggtattgtggcgcggtggtgccggccacgcttggcccgaagccggcgaccgggtcgatgtcttcgaaggtctgcacaatcgcctcgtcgtaatgcgaggtcacgggttgctgcgccggctcgtgctccggctcgcggtgggattccgcggtctgctcgtcgggtcgtgccatgtgcacagcggaatcctcgcgttcctgcgccgccgctgggcgagagtcgccggtctgctccgcggaatgccgaggggtgcgggaatcttcgtccggttgcactgactccttggcggcaccttgcgcatcagcggcacgcgaaccggaatcctccggcgacgccgtggtctgcggctcaggctgtgcgggcggcatcaccttgaaggcggggaacatgggggagcccccgttcgcgatctccagcgcgcctatgatcggctcgttgagttcggtctgcaatacctgcaatgtctgcgcgttctccacatcgagaatgatcgtggtgccgaccaccgcctcggcagtgaccccggcgagccagccctgttcgcgcgcggtgagtctggagttctgcttgatcaacgcaagcgtgtcggaccaaatggtctgcgcctgcgtggcggggtcgagattctctgcgttcatcgagcacttcacccattcttggagtcagatatagataacatactattcttactccatcgagcagaagttatccacaggcttgcgtgttgaaaacactgggtttttgctcccgcaacaggttccgatgtggataggttgcgcgaattgtccccatatttcaacgggtttgtgggtaatgcggcgaatctgcccacagcgcacggtgtacattttcgcgagcctatgcaccacggcaattgtggaaatgtgcatgaatcacgcccacgggtaggggtgcttgtaaattggtagagcttgactcatgaggagccgtgcacgagcatggcctaaattaaccgggagtttgtatgaagaggacattccagccgaataaccgccgccgtcacatgaagagcggcttccgcgttcgcatgcgcacccgcgcaggccgcgcgctgatcaaccgccgtcgcgccaagggccgcaagtccctctccgcctgattcgcacgcgaagtggagcggctgaaaaaccatcgcgaatttgtcgccgtactcaaacgccgccgtcgggtcagtgacgcggatattgtgctgcattacgtggtgcgcacgccgtcgaccccgaccggtgcggcaccggcgaggcgtttgggtttggccgtctccaaatcggtggggaacgcggtggttcgcaatacggtgaaacgtcgattccgagtattggcgcatcgctatgagcatgagcttcccgcagactgcgatattgtgctgcgtgcgaagccgggggcggcgcatgcctccttccagtctcttgaagcgcagattcaggcgctgtttcgcgcagtgatgcgcaaatcggagcaatcgtgacagggtatgcagggcgagtgatgattcgttgcatccgttggtatcaacggcggatttcggcgaatacaccgccctcttgccattattaccccagctgttccaactatgcccttgaggcgatcgaacggttcggcgccattcgcggtggcatgctcgccgcattgagactattgcgctgcaggccctggaagcgttgcgatattgacgatgttccccaacgtttctcgctgttctacagatgttcgtggtcgaaggcacatgaggagccgagacttaccccgctgccatcacacgggaaggagcaggcagcctaaatgaattccgaaaactttcttcttgacgctggcatctggggattcgtctacaagatcctcacgccaatagaatggctcatgacgtgggtgatgtgggtcttccacaagctgttcacgttcattggcatgcctgagcacggcatctcatgggcactggcgatcatcttcctggtgatcgtggtgcaggcctgcgtgttcccgctctactacaagagcatgaagggcatgcgcgccatgcaggcgatgcagcccaagatgatgaagatccagaacaagtacaagggcaagaacgacccggcttcgaaggaagccatgcagcgcgagatgatgaagctgtataaggacaacaacgcgaacccggccggttcctgcctgccgatgctgttgcagggcccggtgttcatgtgcatgttctacgtgctctccgccatcccgtacatcgcacgcggcaagcgcagtccgctcggcgccttcgacgtcgccaccgcggagtcgttctcgcaatccacgtatttcggtgtgaagatcaccgattcgttcaccaccgccaccacgaccggcaaggtcgtgatcggcatcttcgtcgcgttgatgtgcgcctgcctgtggtacatgcagttctattcgatgcgccgcaacacggcgccggcctccgtgaaccgccagagccagatgatgcagaaggccatgctgtgggtcttcccgatcatgtacatcttctccggcgtggccatgcctttcgccgtgctcatctactggctcgcgaacaacatctgcaacctgctgcgcaccatgtggcaggtgcacgaatttcccacgccgggcagcccagccgccgaggcgaaggagattcgcgaccacgacaatgagaacaagaagcgtgagaaggaaggccggccgtccctcgaggaggaggagctcatcaaggccaagcaggaagccgaatcccgcgtgacccaagggttccagcgcgaacagccgaagcgcaagaaccgcggcaggaagaagtgaccggtcgcctggaccggtgagctatatcggcaaggcggtcggcgacatactcggtgtcgtcggccgcacccacctgcaagaccaacgatataatcgagtcagtatgagtaaggagtgccaacatggtgcagactgacgacaagacgcttgaccagctcaacgaggaggcggacatcgccgcggattacctcgaggggctgctcgacatcgcggattacgagggcgacatcgagatgggcgtgcgcaacggccgcccgatggtccagattgtggccgacgacgacaccgacatcaagcatctgatcggcaagaacggcgaggtggtcgatgcgctgcagcagctcacccgccttgctgtgcagcaggcgaccggcgaacgttcgcacctgatcgtggacgtcgacggcttcctcaagcgcaagcggcagaccctgcgcgacatggccctggatgccgtggacgaggtgcgcgaaaccggcgagcccgtcgatctcaagccaatgaactcgttcgaacgcaagatcatccacgatgtcgtgcgtgacgagggcctgcgttcccgctcgcatggcgaggagccgcaccgctatgtcacggtgtatctgaagcgtgccgaggccgacggtgaggcagtcgaggaagacgagttcctcgtcgacgactgagccgcctgttcgtctcgatgaaaccggcgtcgcactccagtggtgtggcgtcggttttgcatacaggccacatgagtggcagtgcggtgcggtggggccggagtgtgcaagtagtggagcaacgtcgagggctaccggcagtgcggtgcgcgatggggccggccgggaaggattcgtcactgtcgcaagctcccttacgttcctcatctttcccggccggccccatcgcgcaccgcggtgattcgccggtacctgctgccaaatgggaaaaataattcgcggcgcatatattcttcccgtgaaccatgggctgcatcagaagaaaatctgaaattcaatattttcttcccgcgagaggtctgtagattggaagaaaatctgcggttccatattttcttcccataaccggctgatcggcacgccttggggtttggcagggtggttaggatgggggtatgagtgagatgatgagcgacgagcagattgagcagtccgggattctcgagaccatattcggcgacgcattgccgaaggtgcgggcgttctacgagaaactgaaatccgagggggagccgcgcggactgatcggcccgcgtgacgtcgacattctgtgggagcgccatctgctcaattccgccgccgtggtgccgttcattcgccaggccacgagcggcaagcaattccgttcggtcgccgatattggcagcggtggcggattccccggtctggtcgcggccgccatgctgcccgaccacacgttcacgctgatcgagccgatggaacgccggtgcgagtggctctccgaatgtgtggagacgatgggtctggagaatgtgcagattgttcgcgcgcgctccgaggaggcgatcgccgcactcgagcaggcacgcgggaaatcctcgggacgcggccatgccaagaacacggtgactcccgaggtggcgcaggcgatacggcatccgttcaccgtggtgacctgccgggcggtcgcgccgatgacgaagctgaccggatggacattgccgctcgtggcgccgcatggcgagctcattgcgctgaagggacgctccgccggtgccgaaatcgagaaggcgcgcaaagtgattgcgcagtacggtgggcgccacgcgcgagtcaaggaagctgaggtggctccgggccttgagcccacgcatgtgctgatcgtcgacaagcagtagcggccatgtctgcggcggtctggcgactacggaacagattcgtcactgtcgcaagctcccttacgttcctcatctgttccgtagccgccacctcgatcccggccgcgcagatgactcaaatgctcatgaccgccctatgggggagtgattgtataggtatagcgcggagttggtggggtgggcgcgaggctccggcgaggcttcgtcgctggattgcaagcgccctttacgttcctcgacctcgccggagcctcgcgcccaccccaccaactccatcgttgacgaccatctaccggacccattggatgcaccaaggttcatagagatttcgagcggctcaaccactacatgtagtggcggggcattctggttatccacagagttgtccacaatgtgcacatcggcgtgttcttgagttgtggaaatctgcaaaaccattgaaaaatagccgatttctgagattggtatgggggtgggttatccaccggttatccacaatcatccacaggagatgtggataacttcgcgctgggtcgaatgcggaaacgacacgtttcacatgaaacaaaacacggcatgtttgtccgtatgcacgaagaaactggatacattgcgatatgaggaggaatcttcgtgacacaccaagggagcagccctgagttcgaaagcgccgaagacaccattgcgcgaatcttttccgaccatgagaattccggtgtcggctcggaaatcgcggatgcatcgacgcgcctgcatgcattggaacgactgaagttcaagcagcccgcgcagacgcggcgcatcgccgtcgccaatcagaagggcggcgtgggcaagacgagcacgacggtgaatctggcggcagcgctcgcgttggccggcatgaacgtgctcgtgatcgacatggatccgcaaggcaatgcatccaccgcgctcggcgccaagcacaattcgggcgacccttcggtctacgacgtcatcgaggggcgcgcgggcatcgccgacgtcatgcagacctgccctgaattccccacgttgcaggtggtcccggcatccatcgacctctccggcgcggaactggagatctcggatctgccgaaccgaaacgatctgctcgacgaggcgctcgacaagttcctcgacgaatccgagatccactacgactacgtgttcgtcgactgcgcgccgagcctggggctgctcgtgatcaacgcgatgtgcgcggtgaacgagatgctcattccgatccaggccgaatactatgcgctggagggtcttgggcagctcatcaacacgatcggcctcgtgcagacccatttcaacccgttgctgctcgtctccacgatgttggtgacgatgttcgacaagcgcacgctgctcagccgcgaggtgtaccaggaagtgaaaacgcactacccgagcattgtgctcgacacgacgattccgcgaaccgtgaagatttccgaggcgccgagcttcggtgagacggtgatcacgtacgatccgcgcggactcggtgccatctcgtaccgcgaggccgcctacgagatcaatgaacgctctcagattgtgctggaaaccattgcgtcgaggaggaacgagaactgatggcatcgaaatcacggttgggcaggggactcggcgcactgttccccacgcttcccgacgagcaggagttccagcacgaagcgcaggccgcgaagcctgaaccgacgaagccggaacccgcgaagaagacgacagcgcgcaaggcggctaaaaaggcacccagcaagccctccaaggctgcaacggagccaaagaaggccccatatgaccccgaggcctatgcggacgtcgacgggccgatttcgccgctaagctcgacgatcccctcaatgggcgcgatgacgattcatgcggagacggtgaacaagctgtccgcgccgatgacactgcagccacaggcggcggagcaccatgcggcccagcagcccgaccgcccgtcgagcccggtgaaaacgcatggcaagcgcgcgacgatgcctgcgatctcatccatgacccaccacccgagcgacatgttcttcgacggcaccccgctggcggacacggcgaagcctaaggaagaggagagcgaggcgcctgagctcaagccggtcgccgggggctatctggtggagctcaatccgaatcagatcggaccgaatctgtaccagccgcgcaccacgttcaacgaggaggaactgcaggagctcgccgactcgatcaaggaagtgggcgtgctgcagccgattgtcgtgcgcaaacgcccgcaggagcagattgacgaggcgaagcgcaggcaatccgaggagcatgccgcagaccgtttcgccgggcgcatggacagcgaatacgagctcatcatgggcgagcggcgctggcgtgcgtcgcagttggcgggactcaccgagattccggtcattgtgaagacgacgtccgacgagtatatgctgcgtgacgcactgctcgagaatctgcacagggtcgcgctgaatccgctcgaagaggctgccgcataccagcagatgatcgacgagttcgggctgacacagaagcagctcgcacagtccgtctcgaaatcgcgcccgcagattgcgaacacactccgccttatgaatctgccggcaagcgtgcagaagaaggtcgcggcggggcagctgtcgagcggccatgcgcgcgccctgctcggtctcgacaccgatgaggagatggagcagctcgcccagcgcatcatagacgagggtctctcagtgcgcagtgtcgaggagatcgtctcgatgagcgcgaacaaggagacgcgcaagccgaagacgaaccgcaacaacccgtgggccggttctccgattcagcagcacctttcggaacggttcgccaccaaggtctcgatcaagggctccgaacagcatggccgcattgagattgtgttctcatctcccgaggagatgcagcgcatcatcgatctgcttgggtaacccggcgggccgtgggaatctggtcgttctcacatatccaattgtcggaacgaccagattcccactccagagttgtcttttcaactttgcggcaagttaagccagcattttagatgccctcgggaatgtcttccaggtagctttggacgtcaagggcggcgcggcagcccgatccggcggcgacaatggcctgctggtagatggcgtccgcgcagtctccggccgcgaatacgcccggaacgctcgtgcgggtggcgccggtggaggtttcgtcgatccggatatagccatggtcgtcgagatcgagctggcctccgaggaaaccggtctgtggcacatggccaatcgccacgaacacgccgttcgcctcgatcttcgaggtctcgttggtcgccgtgttgcgcagatcgagcgacgtgactcccttgccgtcgccgttgatgcgttcgacgacggtgttcatgagcaggttgatcttcggattctcgcgtgtgcgctcgaccatgatctgggaggcgcggaactcgtcgcgacggtggatcagcgtgaccgacgagccgaagcgtgcgaggaagttcgcctcctccatcgcggagtcgccgccgcccaccacgacaatcggcttgccgcggaagaagaagccgtcgcacgtcgcacaatacgagactcccttgccggaatattcgagttcgccaggcacgttgagatgccggtaattcgatccggtggccacaatgaccgtgcgcgtctggagatcctggccgccgctcaaatgcacggatttgagttcgccctgcagatccgccgattccacgtcgtcgaacacgatctcggcgccgaagcgttcggcctgccgctgcatgctttccatgaggtcggggcccatcacgccgtcggggaagccggggtagttctcgacctccgtggtgttgatgagctggccgcccggggtgagcgcccctgcgacgacgacgggcttgagacctgcacgggccagatagatcgcggccgtatagccggcggggcccgatccgacaatgatgacgttatgtactgttgctgtgctgttcatgactcccacaataggcgcgggttttggattattcctcccgcgttatgccttacgggatgtcgttgtggcttacgggatgtcagatttcgtccattcccgcatattctcatgcacatatggctgttttccacagttgcgatttcgcccttgacatcccgtaacgattgaaagatgccggcgggggtgtggcaaaaaccacacccccgcgaaattgtttccctgaggccgcaagaccgcgtgctagaacgcctgcatcgagttgatgtacagctggttgccgggcagtgaatcgatgggcacccacatcacgatgtcttgcgtgttcaccgatttgtcgagcttgacctcggtggtgccgccttcggcgaacgtgaactcggccacctgctcgccggcgttcgggtcgccgttcgtgttcacgcgaatgtagcccttgccgccagaggactggatcttgatgacgatcttggagacgtcctccttcttgtcgaggtgaatgtaatagccgtagccctgctggccacctgggcggtcgaggaagcgctgcgaggcgaccgggtaggccgtggtgttctcgggcttcttcgtctccgtgggtgtcggggtgggcttgacctcttcggacggctccttcgacttgttctgcacatcttcgccggagcgggtgccgaacggcaccttctcgatgtcggcgtcgctcggccagtaattggtgttctgcttgccgaagccgaacagcgtgccgccagttgccagactgtggatcgccacacccagcacggcgacgagagccacgatcacgacgatgacggccgccgtggcacccttgctgcgcttcttctcctcgccggtggtggtgaaggcgcgcggcggattggtgttcgcgcccggattgctctgcggtgcgaagctcggcggcagcgccggcgtgccggctgcatacgcggcgtcgattgccttccgctcctcctcgagtgcacgctgcgattcggtgccgttcggcacttcgttaccttggtcgtcgatgagcgggatgcgccccgtggtggtgacgccgcgcgttgcatccatagacccgtcacgcacgccggagacatccaccggcacggtcatgcgcgagggttgcataggcggttcgttctgcgcgttcgggtcgaaggccgagaacatctcggtggcgtcggccggcgagatctccgggatggcgcttgccgcgtcctctccgccctccatgtaggccttgctcttgttccagagcgccttgaacgagttcgccggcatggattccgtcttctcgccgggggtctcgtcttcgtcatccacttccacggcggcgaattcggggcctgcagtggaggcgaacgtgagcgagggaagcgtctgcgaggagatcagggaatccggcagttcgagcagatcgctgggcagaatcgggcgcaccggcgcatagaccacggagcaggcgccctccgcgttcgggatgcgcagatcgtgccgggtgagcatgtgcagtggcttgtatgggccgagcagtgcttcgagctcattgagcgtgagcagcggaatcgtcggcgtggtgccgtcctgcagttcgagaccacgcttgcagatcacgaacagttccattggcacatctgcaggcagatcgttgagattgaacttcggcgggaaggtggacggccggcgcgtgagcatgccgtagagcacactggcgagctgacgcacggcgagacgctcgtcgttgtcggcgggcgaggctcccgaggtgtcggccagcgcggtgctgatcgacgcgtcggcgagctggatgccgcccacggtgatgcgcacggtgtcggtggagaccgcgtgatgcgtgagatgatcgcgctgcagcgaggcgagcgccttgccggtctcgccgatcacggtgcgcatggcctcgtagctgagcggggaggaatcgggacgctgcaggtattcggtgagcgagacacccgcgtcgagttgcgtgagcacgacggcgaccggcccgtcgtggagcagctgcagcaccggggtgaaccgtggatccttggtggcggcgagcgtgccggcgacggcgttcgtgttcttgagcacggccttgttgttcacaatgaagagctggcagtcgcgcgagagcacgcggtcgttcgccttccaggcctgcagtcccggctcctcgcgaagtggtgataccaatgtgtaccggttgagaacggtgtctcctaagtgcggcctcatatgctccccatctgtgctttgcgctctcctataagctgattcgattctactgttgccactggtcggccgcgataatccctcagactgattatcttgcagcgcaacggggttttcggccaactcgattggctcgaccacgccaagctgttcgatctgaccatagggttcggcaggcaggtcggtggacatgctcggcgggaagctcggcggcatgctcggggggatgctgggagagaaactgggcgggaagctcggcggcatctccacaggtcgtgccgtgcttgcagatattctgcggccgactgccggcgcggtgccggcggattccccggcagccgtggacggctcggattgcggggccgcgctcttgcgcccgaagcgtgtcttgagcgtggcgatgatgcccatgagctccgcgcacctcaacacccagagcacggcgacatagatgacgagcagcaccacggcgagcacaccagtggccagcacggtgagaatccagccggtgacgccgagtctgggtttgagcacctgcgcgagtgagtagacggggttgcgcagtgccataccgatgatgattgtgaccgcggcggcgagcaacgccttgccgtacgtgacggcgatgcggcggccgtcgagctgtccgttgaaacgcttgcgaagcatcacgacgagcggagtgaacgacagcacgtacgccagcgacatgcacaggcccaccatcgtcgcccaatccgtggcagggaacaccctggtgccgatgaaaatgagcacgagctgcagcgcatacatgagcgccatgaacatgaacggcgagcgaccgtcttcgaacgcatagaatgtgcgctggatgagcaggtaggcactcgccagcggcaggcagatgctcatgcccacgagcggaccgcagatgagcaacgcctgcgagacacccaccgtgggcagcagcgaacgcgtgatggccagcggcatcacaatgaatgccgacgagaagaagcacatgatgacgccgacggtgcgaagcgcgctcgacaggtctgtgcgggcgccgtcgaggtccttggtggcgatggcctgggaaatctgcgggaacaatgcagtggccacggaggtggcgatgagcgagtaagggagtatgtagagcgtgtaggcgttctggtaggtggcgttgccggccacgtcgaactggttcatatgcagggtgcgttcggcgatcgacggcgcgctggtgagaatgcgtgtggtgatcacattgaccacctggtcaatgcccacgatgcccaggctccagccggccaccgggcccatggaccgcaagccaatgccacgcacgccgaagcgcaggtggaagtggaagccaagccgtttgagcggaatcagcagcaccaggccttggaatgccacgccaagcgtccaggtgccggcggtgagcgcaagggtggcgggagtccagaacccgatcggctgctgcgccgcattgccgaacatcgcaatgaacacgccgaagccgaggcagctaatcacattcgcccccacggaactccacgcgtaggcgccgaatcggttcttcacggcgagaatctgcccgaggagcatatgcaggccatagaagaaaatctgcggggtgcaccacagcatgaatgccatcgacaatcccacgagatccgggctgccgttcacgtagatgcgggtgagcacgggggtgagcgcggcgatgatcacggtggcgccgagcagcagcgtcagcgcgaaggtgacgatcttgtcgagcgtctcctgggcgttgtcgctgttgagcgtacgcgtgatgtgcggcaccagcacggcattgaagacgccgccggagacgagcgtgaagatcacctgcggaatcatcgagccggcttggtaggcattggctgccataccggtggtgcctatggcggccgccagcagaatcgtgcgaatctggccggtgatgcggctcgcggccgtgcccgaggccatgatgagcgaattgcgtcctatggaagagctcattcgtcggggtccttcttgcgatggaattggcgccacagacctacaatgcccagcagcaccgcgatgatgatgaacacgatgccgcttttgtcgctgatctgcagcgacgaggtgatcgtggtggtgtggatgccgctgagcggcacgccttcatgattcacgagctcctgattggccaccgtggtgcccgcggtggagacgcgaatctccagcgtggcctgcgcttcgctgcccggcggtacattcacgtcgacaaaacgggaggtgacgatctccattgaatcggtacgcgacgagatgcgcaatgagatcgggtagggtaggctgttcgtcacggtcaccggcagcgaggcagattcggagacgacgttcacattggtgggggtagtcagtccgatgccttggcgcagatagtcgaccatggcctgtgtggcggccgtgagcgcgctggaacgtgcggtgttcgcattgagcgacagcagcgcgagctcgtcgtgggcctgcagccagcggttgctccattgcagggcgcccagcgcatcaccggaagtgtctgacgtggcattgtcgctggcatcgtcggcatcgttggcatcaccgtcgccgggcttggtgttgttggcatcgcccgtctgtgccgcgggcccgcccggcatgctgccatcggcgagcagcacggaggtgttgaagtgctggaggtcacggcgtgtgtgcgccagtgtggtcaaggtcgtgtcgagcgttgttgtgtcatacgcagccgggtcgacggtggtggtgtcggccacggttgccgcatcatcgccgctcatgtacggctcgctggcacggagcgtctccagatcggtgagatcgagccaactcgcctcctgcagcgcccccatgaaggcggcgatgttcgcggcagaggaatccgggccgaaactcaccagcaggcaacggttctggtacggctgttccatttggtagaaggcgctctgcgcgatgaacctctgcagccggccggcggtgttcgtctccgcctgtgcctcctgcgacgtggcttggcccgccgccagctgcgagagcatgggatgcgtggccatcaccgtgacgtcgccgtgggcggtgggcacgcgatagacgccggtgtgcgcggcggtgtcatcctgatcatcgaagtcatgggtggcaatcaccgtgtcatacccttgcatgcgtgccgtatcgagagcctcggtgttccaggcacccacaccctgcatcgcatagacggggcgttcggcagcgccgtcgttgagcacggtgcgcagcgtctgcaccgagctggaggcggcccagctcgacaacgggacgcccgcattctcatatccgttcgcattgtcggcatagctgtagcgggtgatgtcgaaatcggcgggttgcatgagcgcctgcatgtgaggggcctgcagtgtggcgagcacctgcggatccgcgagcgcctgcacatgggggaagcgctgcgtgagctgatccttggtgcgcagcgcctcggcgctcttgccgtccaaggtcgcgatggcggaggcatgcgtcttcgccgagcgatccgcccgcagcgccttgagtgtggtctcgtcgagcgaccagtcgccggctgtgagcggcatcagcatcgtcatatggagctgcggtgtgcgctcgccttgcaagccgtcctgcgagcgcgtgacgaaactgtgcagcgtgctcgtctgcgcgccgtcatcgctgcggtagtcgagtgcgagcgggcgcggaccccacgaattgaactgtttgagaatctcctcgctcgcaggcagcgaactgttcacggtcaccgatttgtgtgcggcgatgcgcggcacatgcagggtgacaagcaggtcgggcagcggaatctgccctcggccttcggcccattcctgcaggtcggtgcgggagatgaaattgtaggtgaagttcgtgagtgcgtctatggagccgtggtccacatccgcgtcggtgttgttcgtgacggtcagattcagtttgtagccggaggatggcgtgatcaccggcgtcatcgagttgaccgtgatcgagacgccgggtttggcggcttggtcggtattcgtcgtggcgtcgggctcctcggcatgtgccgggcgcactgcgaagccggtgcacaatgccagtatgagcgtgaacagcaccgtgagcagcgcagtgcccttgcaccgctgtcgtgccgtgtggcgcaggtcggtgcggtgtggattcacgtttaagcctgcctattcagtttccttgcgtacagccatgcaatcttacgctcattggggtagctgagcacatcgtcgaggtctgcgaaatccacccatatggcgtcttcggcctcgtgatcggggtctccttcaacggtgagctcgccgcccgtctgccgtaatgcgaaatgatgcaccagcttgtggacgcgttgacttgttccggtaaaccaatagtctatcgtggctatggaatctaccacctcgccaatgatgccagtctcttcgtgaatctcgcgcacggcggtctgctggggcgtctcgcccttctctatatggcccttcggcaggcaccattcaagatgtccgctgcgcgaatgccgggcgatgatcgccacgcggccatgcgcgtcgaacacgagcccaccggcggagtattcgcggaccaccggcagttcctgggcgtcgagcgaggcgaacgagctgcggcggtcggtgctgcgccgctgcggcatcattgccggggtcggtttgcctgggtcacgccgtgccgcgttgcgcatggggtgcgccggaaccgctgtgctctgcgccggcacgggctgcgagctgtacaggggttgcgtagcgtgcaatgcctgcatcatgcgtgctgcatgggcggcctgcgccacctgtgccggagtcggtatacgacgtgtgccgcgcgcttgattcggcacagtgtcttccgaggggccggattgttcctgcgcggcttcgtgggaggtcgggtgcgacggcatatccgccggcgtcggcatatgtgccgcttgtgtggaagccgattcgatccgttccgccccgagtttcgccttgactgccctggcctcatcgagcaccgtgttcagatgcaccgtggtggtctgcgatgtgtacatgagttcgtccggcaccagcgggtcgaaatccgggtcgtcggggctcagggcatggttcaccgcagcgttggcatgcatgcgagcaacgtctgcgggagtgatcatggttccaaccatactcaataaatgtgcatatgggtatcggtatgcttgatggcggaatgacgggtgctgcggccaaggcatgcagccgtggcgttatgggcgtttcgccgctcttgcgcactcgtcaggttcttgtattgcagattgggcgtttcgcatgggcgggcgcaaatgaaaggtgcggcgtgaacttcgaggtgtggcctgaagcgattgagctggggcagatgttcgcagatgaaggctttgaactggcgctggtgggcggcccggtgcgtgacctgctgctgcaccggcgctcgcatgacctcgatttctgctcgaatgcgcgcccggagcagttcgagccgattctgcggcgctttggacacgatggcttctgggacatgggccgtaagttcggcacactcggtgcgatgcgccgacggccggatggcaccgaggtcaaggtggaggtgaccacctaccgctccgacgtgtacgacccggattcgcgcaagccggaggtgagctacggcgattcgctcgaaggagatctctcccgccgtgatttcacggtgaatgcaatggcgctcactgtgcccgaccttgaattcgtagacccgttcggcggggcgaacgacctcaacaagcgggtgctgcgcacgccggtggacccatatcagagcttcgacgatgacccgttgcgcatgatgcgagcggttcgcttcgttgcgcagctcggcttctcgattgaacccgagaccgccgaggcgatcacgcgcatgaccgaccgcattgagatcgtctccgcggaacgtgtgcgtgacgagctgacgaagctgctgctctccgaccgcccgcgtgccggcattgaggcattggtggattcgggtcttgccgatgtcgtattgcccgagattcccgctctgcgcttggagattgacgaacatcaccgccacaaggatgtgttcgaccacacgatgatcgtagtcgaccgcgcggtggcattggagaccggcccggatggcccggtgcccgccccggacctggtgctgcgcttggcggccctgatgcatgacattggcaagccgaagacccgcagattcgagccgggaggcaaggtgagcttccaccaccacgatgcggtgggtgccaagatgacgcgcaaacggctcaaggcgctgcgcttcgaccaccatgtggtggagcaggtgagcgacttggtcgaccttcacctgcgcttccacggctacgtggacgaaccgtggaccgatgccgccgtgcgccgctacgtcaaggacgcgggcccgctctacgcccgtctcaatcggctgacgcgtgccgatgccaccacgcagaaccgacgcaaggcgctcatgttcgagcatgcgatggatgagatggaggaacgcgtcgccaagctcaaggagcaggaggacatcgatgcgatccgccccgatctcaacggcgacgagatcatggccgaactcggcatcgctcccggaccgttggtgggcaaggcgtaccgacacatgcttgaatatcgtctcgacaacggccccgtcgatcacgacaccgctgtggccgagctccacaactggtatgcctcgcaagccgagtagcgcgctgtgggaatgccggtgtgccgtgtgcgggccccggccgacgcccccgcttcgtcgaagccgccgtagcgagcgtttgacgaagcgaggtcccaccccggccacaatcatgccggagggctaatgtcatcccacggaagtgtgttccggggccttgggaaggtctttcatgtcgttcgccggcttgcagccctcgatgttcgggatctcggagccggtcttgggcagttcatcggttttcgtgaggttctggaacgtggcgcccagaatcacgtccaccagtttgtcttgccgatcatccatctgcagctgggcgtccgggaagttcgcggcaagcgtgtacgcctgtggaatggcgttcttgccgaacacgatggtggtgcgctccaccttcgcattgtcgtagttgtcaatgctctgcaccacgaattcgcggttttgcagcgcccggccgacggcattcgcgaacccggagaacttcgtgccattgagcacgcgcgtggtcacggatttgctgtcgaggtacttcggtttgctgccatcttcggcaggggatacgcagggcgccaccacaccgtggtccgccccttcggcagtggtcttcacctcgcccagaccaccgacgtggaacaggaacagcgacgaaatgaacagcgcgaccacgagaaccgcgcccacgaccgcgaacacgatcgtctggcgcctgtgcacatactcccggcgttcttcgcgggcgtcattattctctgccatgtccatcctttacatgtaaccggtggttccagtatcgcataagccctgacgcccggcggtccggctgcccgctactcggctcgcatgagcggtgcggccggtgcctgtgcatcgatgatgcggtcgacggccccggaagcctgccatgccgcgcgcgtcgcctcgcgcacccggtcgtcaggcaccacggcgattacagtagggccagatccggagacgaaggcactcgtcgcgcccgcctgctgagcttcgcggatggccacgccgctgcgcggatgcagcgagacggcggcgtgctgcaactcgttgaggtcgccttctcctgcgccgagcacgtcgaaggtggagtagacttctggcgtgctcagctgcgacaggtatgcgccgacgagcatgtgcacgccatcgccggaaggggcatctgcgaacagatcgcccaccgcatgttcgatacgcgggtcggatgcggtcagatcctttatacgctcgccgaagccggtgcccaacgccaggccgccggtgacgcagaacggcatgtcggcgcccaaggcggccgctatctcgcggagtcgtgccaccggccaattgagattccacaacgcattgagcgcgagcagtgtgcccgccgcatccgccgacccgcctcccagaccggctgcgacgggaatgcgcttctctatgctaatggagacgtcaggttcgtgcccgctggcctgcgccatcgcgaacatggcaagcacggcgtggttcctgcgcatatcgctcgtcgacgcggccagatctcccaaatgagtgccggcgagatcgagggagaagccggtgcccggttccttggcggtcaccgtcaccgtgtcgtagatacccacgccgcagtagatggtctccaaggcatgtctgccgccccattcctcacggcgttcccccacatgcaatgtgagattcgtcttggcagggcagtccacatgcacgctggcgtagtctgcgcggagcgtgggggtctggaatcgggcgccgttgggtgcgctcatgcttcaagctccttgcatgcggtggcgagcgccacgaattcgtctatgtcgagcgtctcgccacggcgagtcgggtctattcccgcgcgttcgaatgcgccggagggcacgattttcctcaatgccgcgtgcagtgtcttgcgtcgctgcgcgaaggaggcgtcgatgagccggaacaccagatcgcgccccacactgcggttgttgggattgcgcgggtcgtctgcggcatggcgttcgaaccgcaccagtgcggaatcaacgttcggcgctggccagaacacgttgcggccaatattgcccacgcttttcgcggtgccgtaccaggcgagcttcacgctcggcgtgccgtagaccttggatcccggctgtgcgctgaggcgttcggccacctctttctgcaccatcacgaggaaggagtcgagattgccgaatcgttcgagcagcgtgagcagaatcggcgtcgccacattgtagggcagattggccaccagcgtgaacgtcgcggcgtcggcgagctgcggcaactgcgacggcgtgaccttgagcgcatccatgttgaccacacggaatctgttggtcgcattcggcatgaactcggcgatcgtctgcggcaggcgctgtgccaacggcggatcgatctccacggcggtgaggtcggcgccggtctcgagaatcgccaaggtgagcgaaccgagcccgggacccacctccatcacctggtcaccggcgtcgacgcccgcctcgcgcacaatcttacgcacggtgccggggtcgatcacgaagttctgcccgaacttcttcgtcggcgtgatgccctcttcggcggcgattctgcgaatatcggccgctcccagcaggttcccgccgtctgcttgcgctgtgcccatgcttgctcccgaatccttgtgtgatctttgtgtgatcctgtccgtcaaatgctcaataccaagtgtaggcgtcctcatctgctgcatgcgcggccgcaccactgtcgggcagaccggatgcgtgccaacatgtggcgctccttaataccacccgtatttctcggagtgggcccacgccttgctcggactgccgtacttcggatgcgtggcgatgtagttgagcccccagtcgatctgcacggcggcgtcttctttccagttctcgccgaactgtgccattttgctgcccggcagggattgcggtatgccgtatgcgcccgacgacttattctccgcataccacagccagcttgattcgcggttccacagcttcaccagatcttcccagttcttgccggtccacccgtattgtgccgcggcgccggccgcatacgcttgcgcggcgctcggactcggcttgcacaggcggcaattcgatggcgtgggctgttccggttgctgcgtcggcttttgggtaggtgtcggcgtgggcttcggctgttgggtgggctgcgcggacggttgctgagtaggctgctcagacggtttctgtgtgggctgtgcggattgcgtcggcttgctcgtcggttgctcgctcggcttcgcgccgggctgctggctcggttgtgccgagggggtgggggaggattcagcacttggttccgcggcgtctccggtgttgttttccgttgcggactgcttgtcgttcgtacccgcggaattgcctgcagattggtctgcggattgcccttcgtcgttggacgcgccggagttgtcttccttctggggcgtctctttcacgggttcaggccctatggcgatgatccggtcgattggggtggacagtggggtggtgtccaacagttcgcgggagtcctccttgccgtccacgtaggtcacgcggtagcgcagctgattctgcccgttcctgccctcctgccgtacctcagtggccccgggttcaagcgagtcgtccacaatcgtctgcgtggagaacggaacatcctcggtttcggtgatctccttggtggtcacgcgctccacgcgcagaatggtctgcgagccgtctttcgaaacgctcacgcggtcgttcttgcccagcgtgatgcctttcgaatcgagtatggaggcggcggggagcttgccgttgggggcaatgaaggtcttgccgtccgcgatcacggtgaccggaccgtcggcgttgatcaccagtccgccggtgagctggttatacacgttcttgatgtccacggtgatgcggttcgcggccacttcgttctgttcgaagaaggcgatgagctgttccgcgctgtcggcgaccgtccagaacggcatctgctggccgtcgattgagatggtcgtctggtaggcgctctgcacggtgacggtggagttgtcggtgagctggcccggagtggatgaacgcaccagatcgtgagtcttgagcttgacatgctgttcgcgcagaaacccgggaatcgtggtcgcgaacgtggtgacggtggtggttttgccgttcacctcgagcgccacggtttttcgtgtgcacacgaagaaaccgagcagcagggccacaatggtgaccatactcgacgcaatgcgaatggtccgcaatcgcatcatgcgctgcggagtccaacgtctcgccatggttcctctttcccgttttccgttgcaacagagcccctgcatcttgcgccgcaggcgtggtcgtcgagcaggtgcttgtgaatatgcgctatcgattgtaccgacagcaactcaccttctgcatagacagtgaacgtgaataaagaaatggcttcagcgccgaaacgctgaagccattgaggtaatagggggcgagagagaagggggttatctcgcccccgttgagcgcgaccgctaggggagggtcgctgctcagtccagaagtctcatggttggggggaagacttctggatcttactcgtggtaagtgttattcaattatcaattcaaaggaaatgtaccttcattgtacgcgatacactccccagacacaaccgtggagcctcctgtcgggatcgaaccgacgacctgccgcttacaaggcggccgctctggccatctgagctaaggaggcgcaacgtgcgctcgacgtcaacagctgagcatagcagatgcccggaatcgctggcaaaccggccacgcgcgtgtcacacagagctttcacaatctcggctcggtatgtggaatatatccacggccgtcacagagtatacctcacatgaggcgagggcatggtgtacgcgcgtgtctagctgcagatttcgtggccccgctatcgccgggtgggtcactgtgagttcgtggcagccccggcgttgtcgtcggcatagccgatgagcggcttgccggtcgcgccaatcgacggacgcacctcggcatcacccaccttgttctgggccaggccgattgcctcgaggaacgcctcggcgagcgtcttgtggcttgtgacctcgctgctgttcatatcccagtagtagccgttgatcgtcatcgtcggggtgctcatcgaacccttgagctgtccggagcggttgaacagctcggaacgggtgggggtgtaggtgttcacggcatcgagccacttgtcgtagccgcgctgcatcgccttgccctgcacatccttggagatgccggtgccatccatgcggaccttaatctggtcgtcggtcacctgtttgtacccggaaccctcttcgggttggaagtccttggcgtagaggttcgtgatgaagttgagcagatgattcgggtcgtcatcgtgctcggccacgtagattgccgcattggcggtgcggctcgagtaatcgtcgacattgttcgaatcgccgttgatccacgagtaacggtccatgaagctcatgatgtgcagatcgatgttgatctggcccgcatccatcatcttcacgaggtcctggtcgaggttgcggttgagattgccgcagccggggcacatgaagtccatgtagattcccacggtgggcacgccctccaccggcttgttatagccgttcttcgacatgagcaggcctccgagctcgctggccttcgccggcttcaccttggagtccttgagcgtggcctgcgctgcggattgctcgttcgccgcctcctgctgcctggcggcactcgggtgcgtgttgcgatagacggcgatgccggcgatggcgatgagtgcgatgagcaccacggtgaccacgatgccgatgatcgtctgtgttctgcgttccttctgcagtcgctcgcgcttggcttgtacgcgtgcctgctcctcctgccggcgttgagcccggctttcccgtttcggttgcttcgaatttgcggccatgcccgtcctttccttaccctaagcagtctatggcaacgcccatgctttggcaatcgcgtgcagctgcggcattcgggggagggtgagcttgggtctcgcctcgtcagggcgtctcggtacggcggcttcactgatgcgcttcgcgaggcccgtctgcctgatatgcggtgttcatgggaagaaaaattgggaccgcgtattttcttcccagttagatgcctcttcgcgggaagaaaatatgcgggatcgatttttcttcgcagataggaggtctttcacgggaagaaaaacctgcgctgcatattttcttcccatttggggatgactgatgaatgactggtgcagtgaggactgggcccggcctcccgccttgccggctctagaagccggaccacggcagaatgggccaccaatcgatgcttggcgtggcttccagattgaagatggtgagcgcgagcatgatcacccatatgccgaggacgatgaaacggcggatgttccgatggttgccgtcagggcgcaaggcgagccgctgtttggggctcaggcctacaatcacgcccgcacccgcgcgcagattcgcggaatacgggccgaattgcgtgacggcccatgcaatggcggccgatatggcgagccataggccgttgatgccggtgggggagccggcgagcagcagcacggagtcgagccggctccagggcggctcaggtggcagcgtgtagtaggcgcccggtagccgcacgagatagatggcggcgagcattagcgccacatagatcgcccagaacagcaacagactccagagcgacatgaacaacgccgcaaaggcatgccacggcagctgggccacacgcaacaccttggacccgctgccctcctgcccattgcgcctgagcacatgggccacatgtgtgttgaggttcatgcccaacgtgagctccacccagatcagcatgctggcggcgatgcctgcgcccatggggcaggcggcggccaaggccatcaacggcagtgtggcgagcagcacggggagaatcccgcgggtgcggtgcatgcgcacggtgttctggtacgcagtcgcgaccggtccgtaatcactgggcaaggcaggtgcctgcggggcataagcgccattgggcgcatcatattggggctggtcgagatttggggaggcccctgcgttgtttgcctcagggccgacgggttggaacccggttgcggattgcatggggcgcatggactgagtcgccgcttcgaggggtggtgtggccgcaagtggggtggtcggttgcggccggggcatcgtcgccgtatgctcggagtcccacttccggggaaagctctgttggggtaaaacccttgtgccgcctgtgctctcggcgtcattgaaggaaggtgtgacgatatcgccattgtcgtttgccgcatgcgatgcctgggccataggggggaggggcaccgtacctgtggaggcattcaccggcatggcctcggtgggcaacgactggcggtgccataacgtgcgtgggttctccacacgctcatgggtactgagcacgctgcctgacaccccgggcgcatcggtttccctgcgccctatgcggcgaaggtcaaaagggagcatcgcctcgccgtcactggtccacgcgtcggttcgaatggcctccaacagttcctgtggggtgcagcgttgggccgggtcggggtccaatgcggcgcggaacgcctccagtgtgtgcgggggcagccctgccagattcgcgtgaccggatgcctcgcgttgcagcaccgccatcatgggcgatgtgccgaacaccggttcgccggtcgccgcgaatgcgagcaccgaggccaacgaccaccaatcgctggccgccgtggattcggcgccctcgatgacctcgggggcaatgaagccgggtgtgcccatcacgagcccggtgctggtcacatggctttcgcccggcgtcatcgcgatgccgaaatccacgagcacaggacccgtcaccgagatcatcacattggtcggcttgatgtcgcggtgcacaattcccgcctcatgcactgcatgcacggcgtcgatgagcttgctggagagccgttcgagatcgtctcccacatacttgccgttatggcgaacatcctcacgcagattttcgccctcgatgagttcggtcaccaggaatgccagcgaatcgtctatctccatgtcgacaatctggcagactcccgaattgcggatcttgcgcatagccacggcctcacggcgcaagcgctcacgggcgaccatctgcgcgcggtattcgggcgaatccggattgccgtcgtcggaatcggagagcgacgcccgaaggatcttcatcgcatacgcattgcctccgccgtcaacggcgcgccatacggaacccatggcaccggaaccaaggcgtgactcgagcgtgtagccgcccaccacgtctccgggctgcaattgcaatgcgtatacatcagtcatacgcctatcgtatagcgaacgcactcgcgatgcgaacaaatgtgcgaaaagcgggtgggcgcgtcgcgactatgccggtttgtcgccttcgggggagtcgtggggaggcatatgcccgttgcggttcgcgtgccatctcaatttgcgcgcggtctgccccgaggcttgcatgtgcctgtgttccgcgcgacgcagctgttcgatctcgttgtgcagacgattcaccgaatcggtgagccgcagcagttccgcctgcacgattctggattgcgccgggttcagactcgggccgagggaggaaccgttgagcgggtccggcgcgtcgatgatgtcctcgtcgcccgtcgtgtaatcctcatcggggcaaccccctgcgtcgtgcgtggaggcgttcgcggacggggatgcgcctccgtcctcgcccactgccggcgccgggatcaccggatgcgggcgcacattgacctggtcgatcacccacgacgagatcatggcactcacgatgccgatgacggcgatgccggtgatcatgagaatgatcgcgatgaatcttcccagtgtggtgaccgggtagacgtcgccgtagccgaccgtggtcaccgtgacaaacgcccaccagatcgacagcgggaaactggtaatcgtggcgccgggagccttgtgctccaccgagtattcggcgagcgcgcccacatagatgagcatcgcgaccacggcgaccgcgtacagcgagatgcgcccgcgcgaggccgtgccggccgagcggttgaacatgtgcagcatcggcacgaaccgcagcagccgcagcggctggaacatcggcaggatcatcgtgatgagcagtatcaggttgcttttgaaccagctccaccggttgggcgcgaggtacagcgagatggcgtagtcgatgctgtagagcacccagaccaggttgatcaccagattgcacagccgtgtgtgggtgcctgcgagaatctgccacgagtacgcgaacaggaagaacgcggagagcacgaacatgggcgcgttggtgtaatgctgccaggtgtgcagtgtcagaccgggccgtcgtgcgctttttcttgccgtcatagtgccgattctattatcgatatcgattccgcgcgtgacatgggcgccaagatcaagacaatccgcgaatccactctcggacgatcgattccgcgcgtgacatggacgccaatgtgcccgttctgtgggcatgcttgcgtgtcgcacggcaaatttggcatgatggctatcacgaacctaccagttcgggcaagcggggaagcttgtgcatatgcacgcgacggtgcgcggggcggagggatttgctttgttcgccggattgtgtatagtgaagaaagctcatcgaagagaaacacttcacggagcggtggaaggttgtggcctagtcgaagacgacggttgcaaacggaaacaacacaacacagtaatcccctcacaacggatcgttcggcacgtacctgccgatgaaaggatgaacagcacatggcagaagtcattttcgatcatgtcactcgtatctacccgggcaacgacaagccgtcggtggatgacctcaatcttgatatcaaggacggcgagttcctcgttctcgtcggaccttccggctgcggcaagtccacgaccctgcgcatgctcgcaggcctcgaagaggtgaacaagggccgcatcctgatcggtggcaaggacgtcaccacgatgcagccgaaggaccgcgacatcgcaatggtgttccagaactacgcgctgtacccgcacatgaccgtcgccgacaacatgggcttcgccctgaagatcgccggcaccccgaaggacgagattcgcaagcgcgttgagaaggccgccgagatcctcgatctcaccgagttcctcgaccgcaagccgaaggctctctccggtggccagcgccagcgcgtcgccatgggccgtgcaatcgttcgcgagccgaaggtcttcctcatggatgagcctctctccaacctcgatgcaaagctccgtgtgcagacccgtacgcagatcgcggcactgcagcgccagctcggcgtcaccacgctgtacgtcacccacgaccagaccgaggccctgacgatgggcgaccgcatcgccgtcatcaagctcggcatcctgcagcaggtcggtgccccgaccgagctgtacgaccgcccggccaacgtgttcgtcgcaggcttcatcggctccccgtcgatgaacatcaacacgcacccggtggtcaatggcaaggcccagatcggcgccgacaccatggaactgccgaaggaggccctcgacaagctcacgccggaagacaagaacgagatcatcgtcggcttccgtccggaggacgcctcgctggcggccccggatgaggcgaacgccttctcgctcaaggtcgtgaacgtcgaggatctcggctccgacggctacatctacggcaacatcatcaccgatgattccgtggcccagaagaccactgacacgctgatgtccgaccagaaccagctcaccacgatccgtgtgaatccgcgtgtgctcccgaaggtcggcgacgtcgtcaagatcaaggtcaacccggccaagatgcacctcttctccccgtcgaccgagctgcgtctcaactagccggcgcatccacgtggaaacaagcggaagcgcacaggtagggcgttgacatgatctgcgaaggaccccgttatacacggggtccttcgcatattcgggcgcattctcttccttctgcagattattcgggtgtccggtgcggaatgcgggtaatctaggaatctgaaatctgaataccgcactgtatggcacaaggatgggtagggcatgggaataaccgataatccgcaattggatccgcgcgcgttgaaggcgacgtcggtgaaggccgaggatcccgcgacgccaggccccgggccatcgacgttaaagatcacagcggcgagctcggacccgaagatgttcacgctgccgtgggagaagccgcttgccacctggccgccggaactgctggtgaacctgccgcgaggcatctcccgccacatcgtgcgcttcgtgcacgtgggcgacgaggtgtacgcgatgaaggagatcacgcgcaccgtggccgaacgcgagtacgagctgctgcggcagctgcagaagctgaatctgcccactgtgcagccgatagccgtggtcaccggcaggcatgacgacaacggcgagccgctcgaggcgatcctggtgaccaagcacctgcgtttctccatgccataccgcgccctgttcgcgcgcacattgcggcccgacaccgcggaacgcctgatcgacgcgttggccgtgctcatggtgcgtctgcacctcgcgggcttctactggggcgatgtctcgctgtcgaacgtgctcttcctcaaggatgcagacgcattctccgcattcctcgtcgacgccgagacgggcgatctgcagatcgaactgaccgccgggcaacgcgagtacgatatcgatctggcccgtacgaacatcatcggcgaactcatggatctgagctcgggcgagctgctgccgccggatgtagacgagatctccataggaaaccggctcgtcgaccgctaccattcgctgtggagcgcgctcaccgacaccgacaacttctcgccgaacgagatgtggaagatcgagaagcgcgtgaatcgtctcaacgagcttgggttcgatgtggacgagctcgagatgaagaccgccgaagacggcaagcgtgtgctcgtgcgcccgcgcgtcgtcgatgccggctatgcgaaccgcagactgctgcgcctcaccggcctcgacgtgcaggagaaccaggcccgcagactgctcaacgacctcgacgcctaccgtgcctcgagctggcgcgaaggtgaggatctcgagattgtggcaaccgactggatgcgcgaggtgttcgagccgacggtgcgcatgatcccacgcgaataccgttcgcagatcgagcccgcgcagttcttccacgaagtgctcgaccaccgctggtacatggccgagaaagccggccacgacgtgccgatggccgaggccgtgcaaagctacatcaagaacgtgctgccgcagtaccagctcgacacgaagacggtgaacgagctgaacgccgatgccgatgccggtgtggtcgacgatgaatacacgtatgacgacgcctcgaacaacggcgcgcacactgcgccggcggccggccacgacgacgggtacaatcccgaggacgacccggatgccgccgtatgggcgcactgagagctggctggcagcacgtacgccactctgattgccgatttggtcattggttcgccagattgcggtgatatgacgaaccatgggcatcggtttcgtcattgactcgcgaaaacccgaacggatgacgaaaccgatgcccggcagagagtcagttggcggcttcgccggccttgcgacgtgcgttcacggtggcgtagagtgcgatgccggccgccacggaggcgttcagcgactccacggcgcttgtgatcggaatgctcgcaatggcgtcgcatgcctcgcgggtgagcctgctcaggcccttgccctcggagccgagcaccacgacgagcggatcggtttcgaagccggtctcgcccacgagcttgctgccgccgccgtcgaggccgatgctgtagtagccgcgttccttgagcgcctcgattgcctttgtgaggttcacgacgcgagcgattggcatatgcgcggcggctccggcggagaccttccacgcggcggcgttcactgaggcggagcggcgttccggcagaatcacgccgttgacgccgaaggcggcggcggaacgaatcacggcgccgaggttctgtgggtcggtgatgccgtcgagggcaatgaacaatgggcgtgcgctcaggcgggaggccttggaatccgccatctccatggcacgtgccttgcgctccgcgcgttccaccagctcatgcagcgacgagtactggaacgggtcggccttgaggatcacgccctggtgattgcccgaacgtgcgatgcgatccatctccaaacggtccgcttccagcaggttcagaccatgctgacctgccagacgcacgatttcgcgcgtgcggtcgtcgtgttcaatgcggttcgccacgtacagcacactggcgggaacacccacacgcaatgcctcgagcaccgagttgcggccgatcaccagatcgtcggagttcgacgtgaaatgtgcggcgcgacggcgtgcggctagtcgcggatcggaacgctggcgtttctcggcctgcttcttcgccttgtatgccttatggtagacgcggtcctcggccttcggggtggggcccttgccgcgcagggaattacgatgtttaccgcccgaccccttggtcgggcctttcttagtagccatgcgctcattctctcagcacccgttgtcaagaattggtgaaaaaaccaggggccacacatgatattcacttacaggcataggcttgcgtcgtggtgtgtggaataatggcaaccgttagcattgcgcgacaaagcgtatgcccataaccgcgcagccaggcgtgtgccggcactgcaaaccgtgcagcaacagttgcagtctgtgcaatactgtgcagattgtgtatgcagactctgcagatgttgcgagcagaggcagttgcaggccaggcagagcatggttgactactccgcggctgaccgaggagattatttatggatgatcgcatcatagatccatccgcactgaaccgcgaaccccatgtggaacctgcggatgccgaagaatccaaggaagtgaaggcccaggaggcgctcctgcatgacgttgacccgtcgctcgccagcgccgacgaggtggccgaggccctcaatgtggacacccacaccggcctgagcagcgaagaggccaaacgccgactcgagaagttcggcgcgaacgagctggcatccgccccgccagtgccgaagtggaagaagttcctgcagcagttccaggacccgctggtctatctgctgcttgccgcgacggccatttcgctggtcgcgtggatcatcgagaaggtgaatgcggcccctggcgccgagggcggcgaggcgctgcccttcgatgccatagtgatcgtgctgatcctcatcgtgaacgccgtgctcggctacgtgcaggaggcgaaggccgacgaggcggtcaacgcgctgtccgagatgacggcaccgacctcgaacgtgctgcgaaacggccgcgtcgagcgtatcgccaccaccgacatcgtgccaggcgacgtgctcgtgctcggcgaaggcgacacggtgccggccgatggccgtctgttcgccgccgccagcctgcgcatcgccgaggcgtcactcaccggcgaatcggtgccggtgggcaagaagccggaaacgcttgagaaggccaaggcactgggcgaccgctcgaacatggtgttcaacggcacgtccgtgacgcagggcaccggccgtgccatcgtgaccggcaccggcatgaacacgcaggtgggcaagatcgccgacctgctgcagtccaccgaagacgacaccacgccgttgcagaaggaaatgaaccacgtctcgaagattctcggcatcgccgtgtgcatcattgccgtggtggtgctggtggcgctcgcggtgctcgaaggcttccatagcgtgcatgacgtcatcgactcgctgctgctcgccgtttctcttgccgtcgccgccgtgccggaaggcctggcgaccatcctcaccgtcgtgctggctctcggtgtgcagcgcatggccgcacaccatgccatcgtgaagaagctgcattcggtggagacgttgggctccgcctccgtcatctgctccgacaagaccggtacgctcacccgcaacgagatgacggtggaacgcgtggtcgtgccgagcggcgaagttgaactcaccggcaccggctatgcgccggaaggcgatatggtgtcgctgaacggcgatgccgtgccggagaacatcgcgcaggaggtctacgccacgcttggcgccggcacgctggccaacgacggcgaactgcgcgagggccccaagcctggaacctgggagatcgtcggcgacccgaccgaagtttcgctcgtcgtggcggcacgcaagacgcacgccgacaagcgattccaccacttcacccgcgtggccgagatcccgttcacgtcggagcgcaagcgcatgtcggtcatcacgaagaacgacaccgactcgggcaagctcaccgtgttcgccaagggagccccggacgtgctgctgagctactgcgaccgcatcttcgtcaatggcgcggtgcgcaagctcaccgaaggcgatcgccaggacattctcaagaaagtggaggagctctcgcgtgaagcctaccgcacgctcggcgaggcctaccgaccgctcgagaccgcttcgctgagcgaggtgccgggcattcgtacgaatgccgcgggagacgtctccgacatctcggagcaggcagatgtgatcgagcaccagctcgtatggaccggcatggttggcatcatcgacccgccgcgcgtggaggtgcgcgacgccgtggccgaagcgcaccgcgcaggtgtgcgcacggtcatgatcaccggcgaccatccgctcaccgcggcccgcatcgcctccgacctgggcatcatcgaacagggcggcaaggcgctcaccggcgacgagctcgattcgatggatgagaagcagctcgacaaggcgacctccgaggtctccgtgtacgcccgtgtggcccccgaacacaagctcaagatcgtcgagagcctgcagcgccagggcaacatcgccgccatgaccggcgacggcgtgaacgacgcgcctgcggtcaaggccgccgacatcggcgtggccatgggcatcaccggcaccgaggtgacgaagcagtcggccaagatgattctggccgacgacaacttctccactatcgtcgccgccgtgcgcgagggccgcggcattttcgacaacattcgcaagttcctgcgctacctgctcagctcgaatgtgggcgaggtgttcaccgtgttcctcggcgtcgtgctcgccggcttcctgggcatcaagaacccggattccgtgggcgtgacggtgccgttgctcgccacccagctgctgtggatcaacctgctcaccgacgccgccccggcgctcgcgatgggcgtggatccgacgaccgaagacgtgatgaaccgcaagccgcgcaagctcaccgaccgtgtgatcgacggtgcgatgtggggcgacatcgtctacatcggcctcatcatggccatcgtgacgctgatcggcatggacatgcacctgagcggcggcgtgttcaccgaccgttccgtggatgcgctcggccacgacgcccagatggtcgaggctcgcacgatgggcttcacgattctcgtgttcgcccagctgttcaatgcgattgcctcgcgctcgcacctgcagagcgccttcaaggggctgttctcgaacaagtggctgtggggcgccatcgcgctgtcgattgtgctgcagctgctcgtgatctacgtgccgtggctcaacaccgcattcggcaccacgccgctgccgccgatggcgtggctggagtgcatcggcctggccgccatcgtgctcgtcgcctcggagattcgcaagatcttcctgcgcatgcgcgcgacgcactgattcctctcggaatcccgcaggggcctgcccgtcgtggcaggcccctgccttttcccgggccgggtgtgcggtcgtggcggttcatgccgccggtgaattcgcttggtatcactacactgggccgtatatgtgcgtgcgaggggcatggcagcgtatgcatgcgtccgacgtgcgcaggaacactcatcgtcctttgcaaggagaagctgatgctgctatctgaccgcgacatccgtgccgcgcacgccgagggtcatatctcgcttgatccgtggaccgacgaaatggtgcagccagcgtccattgacgttcgtctcgaccgcttcttccgcctgttcaacaaccatgcgtatacctacgtggatccagcggagaaccagggcgagctcaccgaacagttcgaagtgggcccggacgaaccgtggattctgcaccccggcgagtttgcattgggttctacctgggagtacgtgaagatcgacgagacgctcgccgcacgattggagggcaagagctcgctcggccgcttgggcattctcacgcattcaaccgccgggttcatcgaccccggtttcgaggggcatatcacgcttgagctgtcgaatgtctcgacactgcccgtgaaactctggcctggcatgaagattggccagatgtgcttcttccagctgagctcgccgtcggagcacccttacggctccgagaccaccggctcgcattaccagggacagcgcggcccgacgccgtcgcgctcgtaccagaacttctatcgcgcgcagatcaccgactgatgtctcggtgaatgtatgtacagattgacacagaagggcgaggagaggcatgactgattcggggaatccgtctgatttgcagtttccggtgagtccggagccgcgcgatttcgatgtcacccatgtagtggacaaggatgcgctcgaattcccgagcatggacgacgatccgtcgcatgccgccgcacacgaatcccagctgcaatctgcgggctcggcgaatacggctgcgattcccgcaccgccggtgaacgggcatccgcatgatcacgcgcgccgcaccgcgcgttcgggcgcacatgatgcaacgccgacgccggatgagacccctgcggattccgcggcgctcacgctagccgcgtcccagcccagtgccggccgtcatgcggcgaacacggtgaacggcgcgtctgcgggcgatgccgcgcccacgcagctgttcacgtcgccccatgacgatgtgctggcgggcgtctcggtcaatcccccgttgccggcggaagagccgacgcgcgtcgtctcctcggaatgggagcagattgtagattcgcagacgtcggtgatgccaccggccgcccccgccgcgatgccgccggccattccgccgacggatgcggacggcaatgcagatggatcgggtgacgagcccgacgaggaagcccctcatcattcggcaaacgggggcggcaagagccacacgaagctcattgcgggcattgtcgtcggcgtgctcgtgatcgcgctcatcgccggcggcatcgcatggtggtcgagcagccgcaggaacaacgcgcagcggaacgcatacacgctatgccagaacacgcgcgactcgtacgacgatgcccataccgcacttgcggcggcgctgaaggacgccaatgctctcacgagcacacccaccgatcaggtcgccgatgcgaagacgctcgacacgctgaagagcgccgtggccgacgccgagaagctcgaccagcagtcggtggccgaatgcgcggtggatgccaacacggctgcgatcgagaagaccacggattcgctgcgcaacaccgcgaatgagatcaccaaggccaagagcgcgcttgacgcggcaacgaaggcggtgaacgattcgaagaatatgcaatcgcaatccgccgcgcgcgacgaattgacgaaggccatagacgacgcgcagaagattctcgacgcaagcgccaacgccgtgaccgacgagcaggttcgcaccgatctggagaaccgcatcgcagacgcgcgcaagctggcggacggccagaatctgaacgcggaggatgtgacggccatggtgaagacgctcaccgatgccggcaccgccgtgcagcagtcgcagaccgagtatgcgaaccagcaggctgcgacggcccagcaggcggccgaggaggcgcagcgtcaggccgaagcccaagcccaagcggcccagcaggcccagcagaatgcggcgcaggcgcagcagcagaatgcgcagaccaccacgcccgacacttccgatgccggcacggccggcgacggcaccacgggtgccggtgccaccggcaccgacggtgagacgacgggcaacgggggcaccccggcaaatggcgcacagtgaacgccatgaacgtatgcgcgactatcgcgtatattgagacgcatgagcactgcagatgacaccccgaatcccgacgacccgttcgagccctccgatgatccggagcatctcgacgatctgtctcgcgaactcgacgatctggtcgatttcgccaatctcgagcgtgaaatgaccgaggcggcgaatacgacgccgtcgggcccgtacgcggggcagagcgccggcgaacgcaaacgcatggagccgccggtgggccgcgtggcctcggtggtgcccgggcatttcggcgaccggcttaccgtgaccgaggcgttggcctcgcgaggcggcggcaatgcgcaaccgaaccgaccactgttcgtctgcctgcatggctgggggtcgaatgaggacgacctcgccggcataatgcgctatgtggcgccatacagcgacttcgtatcattgcgggcgccgctcgtgctgcaggaggcgtcgccacgcggattcgccatgcagcagggtgcgtacagctggttccatgacgcggtgccggtgggcgacgatctcgattacgacgcctatgccgccgcctgcgcaatcgacgactgggtgaccacgaacgtgggcgagaaccgcgacgtggtgccaatcggcttctctcagggcggcacgctcgccgtcgaactgctgcgcgtgcacccgcaacgctaccgtgcggcgatctccctctccggattcgtggctccgggcaacgtgccggcgaccacgccgtacgacgacattctcgccgatctgaatatcccggtgttctacgggtacggtgaactcgacacggtgctgccgaaatacatgatctacgagacgatcgcatggctcgaggaacacacctggctcaccgcacgcggctaccgcgggctcgaccacgcggtgagcatggaggagttctccgacctacgccaatggctgctcgaccaggacatcgcctccggcatcatctgattcgcaaccactgccgccgcattcagactcttccgcgaaccgtgccgtgcagtgcagatcggaaggcagatcagaagttcgaatcggcggccacgctcatcacatacacgttcttgcgtagctgacgtgcctgcgcgcgcgtgatgtcgccggcctccaccatgttctggattacgctgagctcgatgccgaagctctcgcgcttgacgtcttcgatctgggtgacgagtgaggcggaattcgccatgttcgggcgcgatttgagcgccgcctccgcgcgccggtaatccatgagcagcgacgacacatactccgtgccgtaggtgttgctgctcatctcctcgtacagcctgtcaatcacatgatcgaaggcgccgagttccagattgcgcagactcgcgtagatctcgttttcgttgacgagcggcgtgctgcggcgaatcgtgttggcggcacggcgggagagcaggaccagacgacgctgtgccaaatgggcgcgtcccttgacctgccagaccacgtgcgaggagtcgtgtttcgtgttcgtgtgacgcagcgtgtccatgatctggtcgagcaggcgttcgcatgcctcgacattgacctcgcgttcgcgctcgctgagcgtggggtcgagacggaattcggcgagcttgcgcttgacgtactccttctcccagttgagcgcgtcgatctgcagttcgatgcgtgccgaagggtctatggtgcccagctggttcttgagccggccgatgcgctgggtgtacgagttgatcaccaccatcacggcggagcggttctcgtcggtggtcagttctgccaattcctccaccgtgcgccgcagcacctctatggaggcctcggtggtctcgcggggcacgtccttcgccttgttcggcgcgatcaccggcagcaggaagttcgaaagcagcagcgtcacgatgatcacgccgccggcgatgaagatgagctcgtcgcgcatcgggaaccattcgccatcggcaatggtgtacgggatcgtgaacatcaacgacagcgtgatggtgcccttggcgccgccgaaggtcatcacggcggcggagcgccagcgttccggcgtcatgcggcgacgcttgtgcgaatcctgcgcgcgggcgaggcgcagcatgcccgagacccataggaatcgcaggccgacgatgagcgtcgagacgcacaggatgaccgcgagcagcgtgtagttgctcaccatcgggttatcccagctcgcgcgcatggcgcccggcagcagcatgccgagcagaatgaacacggcgccgttgagcgagaacgagagcaccgaccacacgcttgaggcgacgatgttcgtccgggccacgttcgggcctatgccggtgcggtcgaaacggatcacgagacctgcggccaccaccgagagaatgcccgagacatgcacggcctcggcgcccagatacagcaggaacggcaggaacaattccatgagaatgcgtgtggtggtggtctcccagccgagttggcgcgaggattcgaacacccaattggccagcacgcccacaatgcaaccgaatacggcgccgccgaagaaggtgatgaggaactcccaggctgcctcgccaacgcggaactggccggtgacggcggcggcgatcgcgaactggaagccgacgatgcccgaggcgtcgttgaacagcgattcgcctttgagcacgccgatctggcgttgcgtcagcgtggcctcatggctcagcgagctcacggcgaccgcatcggtggggccgagcgcggcgccgagcgccagtgcagcggccaacgggaacatgggccagagcgtgtgcagcgagaatccgacgaccaccatcgtgaagatggccagaccgatggcgagcgacagtgacagcttaagcgatttgagcagctgactcttgttgatctcatgcgcctcaaggtagagcagaggcgcaatgaacaacacgaggaacagctccgggtcgagttgcacatccgggaagaacggcatctgcgaggcgatgagaccgagcacgatctgcacgagcggcgtggagatgcgcggcaggaagcggctcaggaacgaggagagcaacacggcgccgagaatgcacaggatgagaatgagaacgctcacaggcttcctttctgtatgcgcggggtctgcagccggcatgggccatggccgatcttctaatatgctgtctggtctcagtatgctgtataagcagagccgtcgtctgcgagcgtagcaaagccagatgtcgaacagtggaagcgctcggcatgcgagcgggcggacgatggcatgcatacaaaggcaggggcggtatcgcgatgacacaatacgcagaggcgatgggcgaggcgctcgcacaggcacggatggcgcgatccgcgggcgatgtgccggtgggtgcggtcgtgctcgatgcgcacggcgaggtgatcggacgcgggcgcaatctgcgtgagcgcgatgcagatccgctcgcccatgccgagatcgtggcgatgcgtgaggcggcagcggtgcgcgggaattggaatctggccgattgcacgctcgtcgtcacgctcgagccatgcccgatgtgcgcgggggcctgcctgcagacgcgtatcggccgcattgtgttcggcggctgggatgccaagctgggggcgtgcggttcggtgtgggacattccgcgcgacccgcatgtgggccatgagcccgaggtgtacggcggcgtgtgcgaacgcgagtgcacggcattgctcgccgagttcttccacagtcgccggcatgcctgatccatgccgaattacttgccgtgtgcgcggaacacaccatggcatggcaaggaatgcgcgattgcgtagcatggcagcgtagtcacattgcaacgacgcatgccgaaaggggaatatgacacggatttccgaattcaacgcgaccacgcacgccggcgaggcattgcatgtggtctccatggagaaccacgacgcggattcggcgttcgcgctcgcgttcgtggccgacgagttgccgcgtgtggtgcattgggggcgccccctcacccagccacgcacgctggtgagcgcagtggacgccctgcgcccgcaacgggtctccggcgcgctcgacgagaccacatggccgagcgtgctgcccacgcaggccgaggcatggaccggtgagccgcgtttcgtggtgcgtcgcgatggcgtggagctcttctgccgtttcgtcgtcaccgacatcgcggtgggtgacgccggggttgccgttaccgccagcgatgccgaacagggggtcgagatcatctggacctgcgagatgcgcgacagcggcctggtgcgtcagcgcgcggacgtgcgcaatctgggcgcggggagtctggagatcggcaaggtggaactcggtttcccggtgccggccgacatgaccgagttgctcaccaccaccgggcatcatttgcgtgaacgttcaccgcagcgccagccgctgacgatcggtcggttccagaaggcgagcatggtggggcgccccgacttcgacgcttcgctgctgctcaatgcaggtcgccccggcttcggcttcacgcatggcgacgtgtatgcggtgcatgtggcgtggagcggcaattcactcatggcggcggagcgcctgccatacacgaccggtgtgatcggcggcgcggaagtgcttgcgggcggtgagatcacgttgcatgatgccgcggactcctacaccacgccgtggctctacggttccttcggcgaggggctcaacgaagtcgccgcacgcttccacgccgacctgcgcgccacccatgcgcgttggcgtgccgagcatggcattgccgacaagccgcgtccggtgatcctgaacacctgggaggccgtgtatttcgagcatgattacgatacgcttgtcaggctcgcagacaaggctgccgcgagcggcgtcgagcgcttcgtggtcgacgacggctggttcggcgaccgccgtggtgacacggcgggtttgggcgactggcggatctcccaggacgtgtggcccgacggcgagcactcgctcaaggcgcttgcagactacgtgcatgccaagggaatggagttcggcctgtggttcgaaccggagatggtgaacccggattccgcgatgtaccgcgagcactccgactgggtgctcatgcccaccgcgcaccgcctgccgatgcaggggcgcaaccagcaggtcgtcgacctgacgaatccgcaggcgtatgcgtatgtgtacggctgcatggactcgctcgtcggcgagctcggcatcgactacatcaaatgggaccacaacaagtacgtgaccgaggcggtctccccgcgcaccggcagctgcgcggtccatgggcagacgctcgccgtctaccgcatgttccacgacttgaagacctcccaccccggcctggagattgaaagctgctcgtcgggcggcggccgcgtcgacatgggcattctcgagctcgcagaccgcatctgggcctccgactgcgtggatccggtggagcgcgccgacatccagcgctacacgtcgctgctcgtgcctccggagatgattggcgagcatgtcggcgccagccccgcgcactccacgcaccgcgcgacgagtcaggagatgcgcatggcgatggcgttcttcgggcatctgggcatcgaatggaatctgctcaaggagccgcagcacgacctcgacctgttgggcgaatgggtgcacgcctacaaggagcaccgcgtcgacttcgaacatggcgtcgccgtgcatgacgatgcagccgacccgaccgtgcgcgtggacggtgtgatcagcgcggatggtgcgcgtgccgtctaccgcttcacccagctcaccacgtcgcagacctacccggccgcgcccatcgcgctccccggactcgacgcgcaggccacctatcgtgtgcgcccgctcgcactgaacatggcgagtggtgagcccttcggcgagatcggcaacgggcagagcgaactcggttggtggaatgcgaacggcgtggagatgaccggcgaggcactcgcaagctacggtctgcgaccgccgagcattcaccccgccaacgcggtgctgttcagcgtgacgcgcgtgtagcacgccattgcggccgcgccttcgctagctaatgtaggtggcgatggcgcgggcggcggcggaatccgaccacagccgccagctgaaccgcggaatcgagaattcgaccggcgcggcctggctgtgccggtaggcatcgatgcccttgcgaatgaactcgcggttcttcttcgcaatgaacgagctttccccgctgacgagcacgcgtgagggcatcgccagattcgagacggtcgccacaagcacgccgagccggtagcaggtgcgttcggcgagtctgcgcgcctgcggccggttcgcccgcagatcgtgcgagaactcctcgaaggtggtcacacgccccatgatgcccgagtattcctcggcgatcgagtcggacgtcaggcattgcgagcagccgatatgcccggaggagcagcgcggcccctccgggtcgatcagcacatgtccggccagaccatagcttttgtcggggttgtctattgggtcgccgtggtcggagatcgaatagcccacgccggcgcccatcgtgatgacggcgaatctgggaacgccaatggcgtcgccgaaccagcattcgtgcagcagcaccgagtcgaggtcgttgaacaccttggtgggaatgccggtgtcccgctgcagcatgccgcccaggtcaacgctggaatcccagtacaggaacggcgcgaaggtgacgtaacggtcgtcctcgacgtggccgccgagcgaaagaccaagcgcggtgggcgcgggggcgtcgggggaggcggcgacgagttcacgcaccatgcgggtgatctgctcgaccacggcctgtggggcggtgttcgacacggtttcggtgatgtcactgccgatggggcggcacatcgtgttcacctcggacaccgtgatggcgccgtcgtgaatgttgacgccgacgaaggcatgcgagtcctcgcgaatgcgcagcgcggtctgcgggcggccgcggcgttcacttgattcgcgtaggtcgaatccctgcggcaatctgcccgcctgcgtgctgccggccggcatctcctcgatcacgccgtcgtaaatgagatcgctggtgatgcgcgagagcgcgccctgcgacagattgaagatctgcgcgagcggcgtccgcgcgatcgggccgtattgcatgatgccgcgcgccacattatgcgtagcatccgaacgactgaaccagcgtggaaaatcaagcgaatccgaattagtttccatgagtatataaatatacgccaattacttacactgtttcaaggcacgcggggtggtgggaatgaaaagggcggttccatacactggcaaccgtcagccggggtaagggagccatcggcgatggaaagtggaaatggacaagggagtcagaatgaagttcgcaacacggatgagacgttcggccatgcgacgcatgctccgcggcatcggcgcggcggtgtgcgcgttggcggtcggcgtgggcgcggcgggctgcggcaacagtgccggcagcgggcaggtcacgctcgatttcttccagttcaaggccgaggccgcggactggttcaagcaggcggcacaggagttcgagaaagagaaccccgacattcgcatcaacatcaacaactcggcgaatgcgcagaccgacctgcgcacgcgtttcgtgaaggaccgcgtgcccgacgtgattaccttcaacggcgactacagcttcggcaccttcgccgcctccggggtgttccatgatttcaccgatgacccgctggtgagcgaactcaacgagggcatggtgaacatcgcgaagaacctcgtgcagacctcggacccggcgaagaagagactgtacggcctgccgttcgcgggcaatgcctccggctacatctacaacaaggatctcttccgcaaggtcggtctcgaccccgacaatccgccgcagacatgggatgaattcattgccatgctcaagaaattccgtgatgcgggcatcaacccggtgcaggccacgctcgccgatgcctggaccacgcaggcgcccctcgcctcgcttgccggcacattggttcccgagagcgaatatgccgcgctgaaaagcggtgacaccacgttcaagcagatctggaccgaaccgatcgagaaggaaatcgaactgttcaagtatgcagacagcgagaagggcgtcacctaccagcaaggcacgcagaacttcgccaagggcacggccgcgatcattccgctcggtacctatgcgattccgcagatcacgatggtcaacaaagacatcgacctgggcttcgcccagatgcccgccacgaacgatgcgagcaagcagatcctcaccgccggcgacgacgtgatcctcacaatgggcgcgaacagcaggcacaaggaacagtcgatgcgcttcatacggttcctcatgagcaagaagcagctcgagaactacgccgacgcgcagtccgcgatcacgccgctcaaggagacctatttcggcaacaaggcgctcgagccggtgcgcccgttcttcgagagcaaccgtgtggcggacttctgcgaccactacattccgtcgtccatcaacataggcggctacctgcagtccgcgatcatgagcggcaacgtgaaccagttcatcgactccatgcagaacgagtggaacaaggtccaggctcgtgacttccgcaagtagtctgcggccgggatacaagggaaggaaagcaaaatgacttcgttggccaatgccgaccagcaggcgcgcgccatggaggacgtgcttgcgaatgacatcgacacgcatcactcgcgcacacccgcgggcaaaccgccccgcaaacgcagggtctccgcgttctcgcgccgcaaggtggaccacgcctattactggatggccgttccggccgccgtgatcttcgcggtgttcctgtatgtgcccttcgtgcgcggcatcatgtactcgttcacgaattcgcaagggtacggcagctgcaactggatcgggttccagaactacttcgccctgttccgcgacgaacgggtcggccacgcctatctgttcacattcctcatcgccatcgccatcaccgtgctcatcaacgtgatcgcattgttcctctcggtggcgctgaacggcaagatcgcctgcaagaacggcttccgcgcaatctacttcattccgtacacgctggccgtgctcgtcataggctacgtgttcaagtacatcttcatgcagccgctgcccgagctcggcaaggcgctcggcattggctggctgagcgagtcgctgctcaccagcgagcgctatgcgtggattccgatcgtgttcctcgccgtgtggcagggcgtcgcctattcggtgctcatctatctcgccggcttgcagaccgtggactccgaggtctacgaggcggccgcgatcgacggcgtgaacgcctggcagaagttctggaagatcacgttcccgctcatcggaccgttcttcacaatcaatctcgtactcaccatgaagaacgcgctcggcaccttcgaccaggtcgtcgcgctcaccgacggcggcccgaactcgaagaccgagaccgtcacctacctcatctggaagggcggtctcaccggcggcgagtacgcataccagacggcgaacgccgtgctcttcttcatcgtcctcgcgatcatcgcgttcattcagctcaagttcttcggcagcaaggaaaaggtgtgagaccatgaccaccgcaaccgcaaacaccatgtcgcagcagtctgcgcaacaatctgcaaccatgaataccgcgccggccaaagcggagaagttccgcaaggaccgccgcatcaactggtggctcaccgcggtcgtcgccgtgttcagcctcacgattctcgtgccgctgtatttcaccgtggtcaccgcattgaagacgccggcggaggcgggcacattctcgctgccgacgagctggcagtggggcaatttcgcggccgcctcggccaaagtggactacccgcgcgccgcgctcaactcggcgatcatcaccgtgctcgccgtctcgctcacgctcgtgacgaacaccttcgtcgcctacgcgatcgcgcgcaacatggacaagcgtttcttccgcttcctctactacttcttcatcgccgccatgttcgtgccgttcccggtggtcatgctgccgctcgccaagcagatgggctcgtggcacctcgacaaccaggccggcctgatcgtcctgtacgtgattctcggcctcggcacgaacctgttcatcgccaccggattcattcgctcaatcccggtgtcgctcgaagaggccgcgcgcatcgacggtgcgggcacatggcgcatcttctggaagatcatcttcccgctcatggggcccatcaacgcgacgattgcgatcatgaccgcactgtgggcatggaatgacttcctgctgccgcttatcatcctcaccgatcagagcaaccagaccatcccgctcgcgcagtatgtgttcagctcgcagttcgccacgaactatccgcaggcgttcgcgagctacctgatggccatggcccccgtgctcgtcgtctacatcttcgcccagaagtgggtcgtcggcggtgtgatgcgcggtgccgtgaagtaacccgcgacccgttctgccgcctgcgctgcgggagtggagcggcgagcgggcgtctgcgggtagcgcatgggcggggagtggcgcatgggcggctagcgcatctgcgtaattggggacagataggcgttctgtctgtccccttttacgcagactattactttcagtaattctttgcctctgcttcccctcttccttttcttcctttgcgtaatttgggacatctgcgggtcggagatgtccctttttacgcagagctagcgttccctttcacgcagagttctttcccgcagagttgtagcgggcaccgcgtcttccggcggcgatcgcctgcgttctgttgccctgttgttttgcgtaattggggacgtgcacgggtctgcgatgtccctttttacacatttacgcagattgcagatgcgcatccgggagtgcgagaatctgtggctgtatctgcatattaaaatccgcaaattgagactgagtttgcaaatatggcacggcaagcggttcgcgagcgccttgccatagtcgggtttgcgagaaaggcacgtctgcgcgctcctagattgcctgtcctgcagcagcggtctcgctgggacccggcagacgcgtcatagttgcccatgatgagactgcgtttgcaaatacggcgagataatctgcgatccaagagccaatctgagcccagatttgcaataacgacacccaattgcatatcagattgcccgcatgagactggagttgcatgaacggcgcgcagccgggtcgcccacgtcagtgattgctcgcgcgagaccggagttgcaagcaaatgcgcgttaggcagtgcgcgctgctgtctcgctgagggggtaatgacgctcggcgtggcgggctggaaacggcagccaaagccggttattgtggcgggaaccaatgcaggtcaacgaagaacggcaggagggagacgcccatgataacggtgagatcagtggtggcgcataccgaatgcgggccgttcgatgagcacggcgaagtcgaactgcccccggactcggtgagcgaacacagaataccgtggcgcacactgcgtagcgcaacggtgacggagataagtgcgcagcttccggaatccaatccgattctcgagcgtcccacattgctggccgggcggtcggtgtccgtacggctgcaattaggcagatcgaagccagtggggccgattctgtgcctttaccagcacaaggaatggtggatgcggccggcatgggtcgagcgtttctgtgacataccggagcgcacccagctggtgctgtggaaatcggcgaaggcgtggcatgtgatgataccggtgttctgtcacgggatgcgcgttgacattcgcggcgatgggcgaggcgacaatgacttgctgctcgatgtctccacgaatcaggttggccatgtgcaattgcaggggccactgctcgtccatcggcaaagcgatcggaaagtcgaggatccttacgagctgattcggggatgcgcggagtgggtcatgttgcagaacggtggcttggggagattgtggaagcagactctgccggaatcgttgcgcggttttggctggtgcacctgggactcgctcggcacgaacgtgagcgagcaggccattatcgccaaaatggaggagttcgccgccaaacacgtgcccgtttcgtgggtgctcatagacgacggttggtctcaagtcgagaacggtaagctaaccggttttgacgccgacacaacgcgcttcccgcagggactctcgcacaccattgacgtgctcaaacacgacttcggcgtgcggtacgtcggcgtatggcaggcgttccaagggtattggcgtggcgtggatgtggacgcgctcgccggcaagcccgaatccgacgatgattggcgcgagtactacaagcaggggtattcggatggggacgcgcgcgttgaggaccccaagctcctcgtgagtcgatccgcgttcgaaacactgcccaatggcatggcaatccccactgcgaatccggagtgtgcagcgctgttctggcgtacatggaacacgcacttggacgccgccggcatcgacttcgtgaaggtggattcgcagggcacacttcctgtgctcacgcgcggcctggaatcctatgcgtctctaggcgttcgccatgatgccgtggaatacgccaccaactggatacgtcacgaagatgacaatggtgattgggaatacgcgcatctcgccgtgatccactgcatgggcatgactcccgagaactattggcagcgctgtgctgagggagtcgcccgtacgagcgacgacttcttcccgaacattcccgaatcgctcgccgagcatgccatcgagaacgcgtactgttcgctgctcataggctgtctctgctactgcgactgggatatgttctggacccgccacccgcacgcgcgcacgcatatgctgttgcgctggataagcggtggcccgatctactgttccgacaagcttggcgagaccgattccgctcctctcgccccgctgttcgatgctgacggcaatctcacgcatccggacggcgtcggcgtgccggtgctcgacagtctgctcgcagacccggtgcatggtgacgttccgctcggcattcgcaatacgttccgcggcgacgaggtgctgctgttcgtcggattgaacgccgatgccccgcagaccgcccacattcgcgcgacggaatctcctctcacggtgttcgatccgcagaccggcgagcgcgtgcatctgagcgtcggcgaagacctcgcgctcacgctgcattatggcgagtgcgagctgcgcatattgcagactctcacataatccggcgcccgcgtgtattttcggcacagctctcggagtcttccgtaagctgtaccgcacagaccccgtttcgtggtctgtttttcggagtcgtccgtatattcgaccgcaaagtgacctgaatatagtcgctttcacggaaccttccgtaagactgaccgcggaagtctccatttgcggtacgactctcggaaccttccgtaagccatgccgcataagctcctttcgcagccagtttcatggaggcgcccttaggaagtgcagtttccagactgtccgatggccggtttctcggaacttcccgtaagacgtgccgcgcgggatgccttttgaggcacggtttacggagtcttccgcatgatcgaccgcaaaagtctacgtttgcggcacggttctcagaatcttccgcataccatgccgcgaccagatccgctgcatgctcagcggcggtacggcacaccggcggcgacgagcctggcaatgagttcgttgggattgagcaaatcctcataatcgaaatggatgatcgcggtgacgccgtgttgccgcagcgcttcgtcgcgcagtttctcccggtgcacgtggtttgcgatggtcttgcggtcattgccgtatttcgtcatgccgtcgtattcggcgacgatcatgcgtccattcggcagaatccaaatgaaatcaacgcggaacgggtattccgggttctgcggattcgggaactccttctgcagctgcggaatcatgagcccgcgttcgatgaatcggcttcttgcgagcgtctcaccgccgttctcactgcgcgggtcggtgtattcgagcacgttgccgatcgcgagtgcctcggtcgcgctgtgaacggggaactgtcgcagatcgtcgagcgccataccgctgcgtactgcggaatctgcgagcggcagtatctgttcgaacggcagcacgagcgcgcattggtagattgtgcacggcagtgtggtgaccttggctccattgatcacgttgtattgcggatttggcgtgtacacgcggtgtatgacggcatcactccgcctggcccggtatatgccgctttcgtgtgtggatgcgatgtggatcatcggattgtcgtgaatctggtacgactgctcgatgccgtacaggcaagccgcgctctgtgcgcagaaaatccagtcggggcgcaccattgccagggcgagtatgacatgtctctttttctcgcgcggattgagcgcatcccaagtttccttccgcgcaaacagttgcggatatggcatggtcaattcgccgctttcgcatctgcggcgtagtttgcggcgcaggttgacgtcggtcgtcaccgcgcatcggtgtgcgttctgggactcgtcgaggagtcgctcgatttgcgaatctatcttcatgctttcgacggtaggagagtgtcgaatgtcgtgcaatcccgatttggaatttgtggataacttcgccgttgtccaccgtattcagcgcctatgggcgcttggaagtgctgttttgcgctttgtttgtggcttgtttttcggaagcttccgtaagatatgccatttctggattcctccttggtgtgtttctcggaaccttccgtacgacgtgccacagattgccgctgtggcgccccattactcggaaccttccgcatgaccgaccgcgcggtggtctcaaaacggtttgtttctcggagtcttccgcaaactgatccgcagattgttctcttcgcggttcattgtgcggagtcttccgtgagatatgccgcaggggtacccgtttgcgccgtgtttttcggaagcttccgtaagatgcgccgcaatagcgcttctttgtggcatggttttcggaagtttccttgagacggaccgcaaaaacgtcttttgctggcatggttctcggagcgttccgtaagatacatcatttgcagactccgccgcggcatggtttacggatgcttccgcatgaccgaccgcaaagaggctccagcatggcattccttgcggagacttccgtaaagtatgccgcgcaaacgccgtatatggtcgattttgcgaagattcccgtgcatgtgaccgcggaattactttcccacacgcccgtccgcatactacgctaggcaattaattcaggggtgcctactatggagccatctctatagtgttggcggttgttattcaaaggcaaaggagcttccatgaccacaatgaataggcctgtgcttcccgattccgtgcgtacgaacggcgcgacgccgaacccgtggtgggcgaacgcggtggtgtaccagatctatccgcggagtttccaggattctaacggcgacggcatcggcgatctcaagggcatcacgagccgactcgattacattgccgatctcggcgtggacgtgatctggctgagcccggtctatcagtcgccgcaggacgacaatggctatgacatttccgactatgaggccatcgacccgatcttcggcacgatggatgacatggacgagctgctcgccgaagcgcacaagcgcggcatcaaggtgatcatggacctcgtggtcaatcacacctccgacgagcatgcatggttccaggagtctcgcgaccccaattccagcaaagcggactggtactggtggcgccccgccaaaccgggcatggaaccgggggcaccgggcgccgagccgaacgaatggggctcctacttcggtggttccgcatggcagtatgacgccaagcgtggcgagtacttcctccaccagtattcgaagaagcagccggacctcaattgggagaatcctcaggtgcgtaaggccgtctacgccatgatgaactggtggatggataagggcatcgacggcttccgtatggacgtgatcacgcagatctccaaggtggtcgacaagaacggccgtcttccgggcgaagcgggttccgagatcgatgactacccggccggcccagaagggtactcgagcccgtacccgttctcctccgacggcccgcgcatcgatgagttcctgcaggagatgcgtcgtgaggtgttcgagaagcgcggtggctatatgaacgtcggcgaggcgccgggtgtggacgctgcgcgtaacgagtacatcaccgatccagaccacaaggaactcgacatgctattcctgttcgaccatgtgggcattgaccagggcgattcgaagtgggacatcgtcaagttcgatgtgcgccacctgcgcgagcagctcaaggcgcagcaggaggccgtgcacgaccgcgggtgggcgagtctgttcacctgcaaccacgaccagccgcgcgtggtcactcgctggggcgacgattcgaatgaggagaaccgtgtgcattcggcgaaggccttcggcatgctcatccatctgcatcgcggtaccccgtacatctaccagggcgaggagctcggcatgacgggcgcacatttcacggaactcagccagtaccgcgatctcgagtcgatcaacgcataccgccagcgcgtcgaagaggcgaaggtgcagtccggcgagtccatgatggattcgctcgcgctgttcggtcgcgacaatgcgcgcacgccaatgcagtgggatggttcgaaatatgcgggattcaccgcggctgacgccaagaccgagccatggctgtcggtgaacccgaaccatgtggagatcaatgccgccgcacagttcgacgacccggattcggtctacgcattctataagaagcttgtcaatctgcggcataacagtgccgttgtgtcggccggggaatgggcgctcgtcgacgacgatgacgagcaggtctacgcgttcacgcgcacgctgacgaacgcggacggcacggcggagcgcatgctggtggcgatcaatctgactggtcggcatgccgcgctgccgaagccggtcgcggatctgctcgccgacggcgtgagtgaagaccggatcatcctgagcacatacgatgccatccactccgcgaaatccttggcaaacggcgagctcgccggctgggagggcgtcgtcgtcgaactctgacgctgacgttcgcaaacggaatctgagcgcggtcctgtttcccgtgaaacacatcgaatgcgggaaccagggccgcgtctgttcatgctggaagacgaactatgtcagcagtcggacagagtgtgacgcacgcgcggttttttcttaaacttggctcccatggaacagaaagatgtgttgcaagcaatgcgcagggatcacgctgcggaactgaagatggccgccgaacgactcgaggggactgcaaagcacacgcagatcatcgcgtcgccggtgctgtcggagatgaccgggcacacgatcctgctcaagccggagaatctgcaggtcacaggttcattcaagattcgcggcgcttacaacaagatcgcctcgctcaccgacgaggagctcgagcgcggtattgtcaccgcctcggcaggcaaccatgcgcagggcgtcgcctatgcggcccatgagcgtggggcgaaggcgacgattctgatgccggagatcacgccgccgctcaaggtggacgcgacgaaggcgtatggggccgacgtcgtgctgcacggcgatgtgttcgacgaggccgcggcctacgcgatcgagctgagccagcgtgagggcatgatctacgtgccgccgttcgacgattatgaggtgctgtgcgggcagggcaccattgccatggagattctcgaagacgttccgggtgtcaccgacatcgtcgtgcctcttggtggcggcggtctgggtgctggcgtcgcgctcgccgtgaagatgttccgccccgaggtgcgcgtgatcggcgcgatccccgagggttcgccggcatttcgcaggtcgttcgacgccggccatgtggtgccggccgacaaggtggtcacgtctgcggagggcgtggcggtgcgtcgtcccggcgatctcacgttcgcgctgctcaacgagttcctcgacgacctcgtggaggtctccgagcgcgatatcaacgagatgatcctgctcatgctcgagaagcacaagatggtcgtggaggccgcgggcgccgtttcgctcgccgcgctcgaacatctcaatctgcgttcgcgcaagttcgcggaggcgccgggagagcacgtcgtcgtgccgatcatgtcgggcggcaacatcgacacggtgacgatcggtgcagtgatccagaagggcatgatcgcgcgcggccgcatcatgaatttcgaggtcgagctgcccgacacccccggccagctggtcaaggtcgccacgatcctcgcgaaggcgcgcgcgaatgtcatcgcgctcgatcacgaccagttcaaggcgaacggccattacacgaactcggtggcgctcggtgtgaccgtggagacgaacggcccggaccatatcgaacaggtcatgcagatgctgcgcgatgccggttattcacccaagcgaatctactgattccgcgatctcgccgcccggtttcatctgccggtctgcagattgcccaccggcgattatctgctaatctggtacgtttgttgccaagcaatgtattgggcccgcgttctgtgcactggaacgcgggcccaatactatgtgcgggaacgccgtgcgctcacctgttgtctgcgatggtccgctgcacgagctccggcagcgccaccgcgatgtcttcgtgaatgaggcgcgtggcgagcgaatcgtactgtgtgcggcccatgttcatgatggtgatcggcactcccgcctgcgccgcggccggaacaatcgacgccgccgggaacacttcgagcgtggacccgaccacccacagttcgtcggcctgctgtgcggcgcggatagaccgttccatcgcgccttccggcagcgcttcgccgaagtagacgacgtccgtcttgagcagcccgttgcagggcatgttcccgcggtacggcagctggtgatggcaatgcggatccggctcctcgtcaagccgtgccatgatgtctgcggtgtcgtatttcgcatggcacttcatgcagtgcgacgtgccgatggtgccgtgcagattcacgatcttgctcggcgaattccccgccttttcgtgcagcgcgtcgaagttctgcgtggcgatgagactgagcatgcccgctttctcgaggtcgacgagtgcgtaatgcgctttgcccggcttcgcgttccacaccggcgactccttctgccaacgccaggagtattcgcgcgcctccttgtcggtgaggaacgcatcgatgtcgtacacctgcatctggtccggatgcttggtccatacgccgtccggcccgcggaagtccgggattcccgccgaggtggagattcccgcgccggtgagtaccacgatctgtttcgtcattgtgctgcgctcctgttcctgattgttggcgtgtgtgttgcgttgattacaggcttaccacgcgcgccgtctattcgagccccgcgcgccatccggaaccgtgcaatggatcgtgccttgtcgcatcggtggattcgcgtatgacgagccggctttccacttggaacacaccgtggtgcgggcgcccattgatcgcgtcgaggagatgccgtgcggcacggcgtcccatggtttccaattcgttgtcgaaggatgtgagtgtgggatgcacgttcacgcagaccgagtcccaattgtcgtgcccgatgaccgcgatgtcctgtggcacgcggtgaccgtgcatctgcaacgtacggcacatgccgcgcgcgatctcatcgttgaggcagtacaccgcatcgggcatttcatcgcgttcgagcagtagttgggcggcgcgttcgccccaatcctcactccaccggtcgttgatgacgagcagcggcgccgccccggccatgcgtagtgtgtcaagggcaccgcgctcgcggtcgatcgtcgcctggaagaagtccaagcctcctacgatcgcgatgcgccgtcgcccgatgccgagcaggtattctgccgcctgccttccggcaccctcgttgtcgcagatgagactgcaatcggctgggtcatccgaagggtcgtaggcgtagacggtaggcagaccattctgaatgcgtggatcaatcgggtgccgtgcattgcacgtgttgccggcgatgatgaggccgtccactccttgggcgctcaattggttgatatggctgcgttcgagcgcaggaacaccctgtgagatcatcagcaatgcggcatggttgtgcgcgccgagcgcgcgttcggcgccggcgagcagcggcagcgcaaaacgaccgttgcggtccggtgtcacgatgccgatcaatccggttcggccgtttcctgttcgagtcttggtggctggcctggcatatccaaattgtgctgcgatatcccgtactcgccggcgcgtctcggcgctgatgcgtccggtgccggtcaacgccttagatgcggtggaatcggccacgttcgccgctatcgcgatgtcgtgtaatgtgactttcttcgccatgattccatcgtaatcgcaaaagcgagtggaaggaaatatttcccaaccatcgcacccatgaatacggtgtttttcagaattctatattgagggtaacagctcggcaaagaggcgcagagctcctcaggaaaggcatggcgatggcgaatgtaacgatcacttccccgttctggaaccggtaccgcgaatccgtggcccgcgaggtcatcccataccagtggcagatcatcaacgacgaacgccgcattgaaatccccgtcgacccggcgggcaacgacgacggcgaagtcaacgatggcctgtcacgcgaatggagtcacgcagtgcgcaatctgcgcgtcgccgccggcgacgtggacgccccgttcaacggcatggtcttccaggattccgacgtctacaagtggcttgaagaagcggcatatgcactcgcataccaacctgatgcacaactgcaggcgctgtgcgacgaggtcgtcgatctcattgcgcgcgctcagcagccagacggctaccttgacaccccgttccaaatcaagtcgggcggctatgcgcgtcgacgccgtttctcacagattcagcagagccacgagatgtatgtgatgggccactacatcgaggccggcgtggcctactggcaggtcaccggcaacgagcaggcgctgcagatcgcgtgccgcatggccgactgtctcgatgccaatttcggtgatgaagacggcaagatccccggcgccgatgggcacccggagatcgaactcgcgcttgcccgcctgtacgaggcgacaaacgagtcgcggtatctgcgtctcgcgcggtatttcatcgatgtgcgcggcaaggaccccgatttctacgacgagcagaacaaggccgtgcatgccgagggcctgccggcaatcttccccgcaatggagacatggagccacgaatacacgctgaccgcgcgcccgatccgcgaccagcagaccgccgtgggccatgccgtgcgcgtggcgtacctgctcgcgggcgtgatgcaggtggggcgcctgacgaacgatgaagggctgctgcgcaccggtgagcggttgtggaacaacatcgtgcacaagcgcatgtacatcaccggaggcatcggctccacgcatgtgggcgaggcgttcacctacgactacgatctgccaaacgacacgatgtacggtgaaagctgcgcctcggtgggcatgtgctttgtcgcgcgccagatgctcgagcatgagctgcgcggtgaatatgccgatgtgctcgaaaaagaactgttcaacggagcaatcgcaggcattgcgctcgacggcaagcatttcttctacgtcaatcctttggaagcagatgttcaggcgaccgagaacaaccccgaccgccgacatgtgctgctcgaacgcgcacaatggttcggctgcgcatgctgcccgtcgaatatcgcccgtttgatcgcctccgttgaccggtatctgtacaccgtgcgcgaagacgaacgcatgatcgccgcacatcagttcattgcgaacgacgcccggttcttcgacgacgtgcgtgtgaagcaggaatctgatttcccgcgcgagggtgtggtgcgcttcactgtggatgtgccggagggcgctgatccggtcatattcaaggtgcgcataccttcatggtccccagagtaccgccttacggtggatggggtcgacgtcaccggcgagatgccggtgcatgacggattcgtttccgtggaggtcgcggatcgcacggttgtggagctcgaactcgacatgagcgtgaagtatatgcgtgcgaacactgcgattcggcacgacgccgggcgcctcgccgtgatgcgcggcccggtggtctactgtgcggagagctgcgataaccgtgcaccgctgtgggattaccggatcggcgattccgcaggtgaagacattgcatgcgctgcaggcactggggtcctcgaaggattgcagacggtgagtgttcccgcgctgcgcacacctgatgacgcttccgacgccccgctgtacatgcctgcggatcacggtgcgcgccaagccgaccatacgcgtctcgagatgattccgtaccacgcgtgggcgaaccgcggtgcttcgcaaatgcaggtctggttcacggcgctgtgctgatttgctgatttctatatttgccaccgtacttggaatgcgatgtaacgccggtttgctcctgtaccggcgcggcgcggcggcatctcccccagtcccgcatgcatgggcgcatgcgggcgtccaacacattgcagatgcattcgtctgatgggctcacacgcatcagatgaaagagagaaaggacaatcatgagcgatacagtttccaacaatgcttccccggccaccgaggtgaccaaggaggccggcagggtcaaactgcccttcaaggagatggtgagctactcgttcaccgatatggcgggcaatctgctgtatgtcaccctctcctcgtacatcatgtacttctacaccgatgtgttcggcatctccgcgtccggtgcgctcggcgcggcgacgatcctgcttgtcgcgcgcttcgccgacgcgatctccgccgtcgtgtggggttcgatcgtcgaccatacacgcacgaagtggggccagtgccgcccgtggttcctgtggctcgcggtcccgttcgcggtgacggtgttcatcgcgttcacggcaccgtccttgccgaatgagacctccaagttctggtacgccctcgtcacctacgtcctcgcagcgggtgctgtctataccggcatccagacgccgatcacagcgattcttccgaatctcacctccgacccggtcgagcgcaacaacgccaattcgttccgcatgctcggcggtaacatcggcagcttcatcacctccgccttcacgattccgcttgtcggattcttcggtacgatgcttggcggtggcgaccgcagcggcttcatggcggtcaccgcgctctatggcgtcatcgcgatcgtgctgcttgtgctggcgttccgcaacctccgggagcgcaattaccacccggaagtgcagaagccgatcccgttcaaggattcactgcgtgccgccaagggcaattggccatgggtcattctcgtcaccgccttcgtcatctactggatcgcgcagtccacacgcaacggcatggctgtgtactacgcgaagtacaacctcggcaacgagaacctcacatcactgttcaacggtgtgcaggtgatcggcatagtgggtacgatcgccatgcctattcttgccaacaagctcaagaacaagacgctgaccatgatcatcggcctggcgatcggcgcgatcgggcagctgctcatgcctctcgccggctcgaatgtcccgctcgcgttgactttctggacgattggcgtgattggcgcggccattgcatgcggtatgccgttcggtatgctcgccgatacggtggattacggcgaatggaagaccggcatccatgcggctggcttcctgacagccgtcggctctgcgttctgcatccaggtcggctccggcttcggtgcgttcctgccgctgcagatcatgaatgcgaacggatatgtcgccaatgcccagcagtcgcagcaggcgctgaacgccataagcttctgcttcatctggcttccggtgattgtatacgcgattgtagcggccatcatgtgcttctaccgcaagtacgagaagatggagccgatgatcaaggaagagatcgccgtccgtcgtgctcgtgaggtggaggaagtcgccgagtagcgctgtgacggagtagctactgcaatttggggcgggttgggcatcgaggagatgcccaacccgcaccgattgttcatccgcctggggagacgaccgaccagtggatcggtggtgtcttctgcccgttcggcttttctttgtgtaattcggattgtgtgcagcccagctcccgtcttggtttgggggtgtggtgttgggttttcgacacgccggtggtggtgttgtgtttgttggggtttgggggtgtgtggttgggggtggggttgcgtgggtgggggttgtggtgtaggtttttcttttgctgccgctcacggcctgccggggttcccgggtcggggttgtgggtgtgtggtggtggtttgagaactcaatagcgtgtactgtactacttgaccaaggttgatgtcgcttcggctgtcgtggccgttgtggttcttggtcgtcttttatgatgccagttccgttgtccgcctgcatggtttcgtgtgggtaatcctgtcgggttttgatggatggcggaggttttttgtgtggctccctttccttattagggggtccgtctgatttcttttgaaatggatttgagagtcgtttttggctttctgcaatgttttttgtggagggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctttctacggagaatatgggcgtgcatggttttgtgcacggttttgtggctggggtttgccgagtgcgatggtttgtcgtcgccgccctggcttgctggcgtggaagagtcgtattggattgtgtggtgtggtgcgtgctgttgggttccctggccgccaccggcccctggtgtggggtgtggttgccagtgtgtcccccaggtcggttgcccggtgcctgttggtgcggggtgggtgtcctggtggggtggtggtttgagaactggatagtggacgcgagcatcggcccgcccgttggggtggggttggtgttcgtactgtgattcggatccgaggaattgttttttcttgggttcgttcgtaatcgtatgggggcgtgccgtgtgtggtgcgtccccgtgatctgatgtcgttctagggtttttcagtagtgctttggtcatggcggccgtgttgtggttgtcgtgatgggcgtatggtggatgccttggcagacagtaccgatgaaggacgtgtggggccgcgatagtcctgggggagccgccgacatggctttgatcccagggtgtccgaatggggcaacccgccagccgtcatgggctggcaccgcacttgtgcggggggtacgcagggaagtgaaacatctcagtacctgcaggagaggatactccgtgagtagtggcgagcgaaagcggatgatggctaaaccgtgcgcgtgtgatacccgtcgggggttgcgcgcatggtgtcgtgggaacgcctgtccaacggccgacgccgttggctgtggtgataaatgcatgcgtgaggcgaaccgggttggataccgggccgtagagggtgatggccccgtagccgtatgcgcgtgcaccatggatggtgtctcccgagtagcgcgggactcgtggaatcccgtgtgaatccgcccggaccgtcgggtaagcctgagtatacctgtctgaccgatagcgtacgagtaccgtgagggaaaggtgaaaagcaccccgggaggggagtgaaagagttcctgaaaccgtgcgcccgcgaaccgtcggagcccccttggtggggtgacggcgtgcctatcgaaaaatgagtctgcgagtcagtggcatgtggcgagcataagccgtgtggtgtatgcgtagcgaaagcgagtcttaaaaggcgtcttttcagtcgcgtgtcctggacccgaagcgggatgatctagccctggtcaggttgaagcgcgggtaagaccgcgtggaggaccgcacccacttaggttgaaaactgaggggatgaactggggttaggggtgaaaggccaatcaaattccgtgatagctggttctcttcgaaatgcatttaggtgcagcgtcggttgattgcgtgtggggggtagagctactggatgcttgcgggcccgtgccgggtaccaacagcaaccaaactccgaatacccatcgcgtctattccggcagtgagtcggcgggggataagctccgtcgtcgagggggagacagccctgaccgtcgtctaaggtccccaagcgcgtgctaagtgggaaaggatgtggagtcgcatagacagccaggaggttggctcagaagcagccatccttgaaagagtgcgtaacagctcactggtctagtggttccgcgccgacaatgtagcggggctcaagcacgccaccgaagacgcggatgcggccgtatggccgtgtggtaggagagcgtcccacaccggggcgaagcggcgggggaacccggccgtggactgtgtgggagtgagaatgcagacatgagtagcgagagcagggtgaggatccctgccgctggaagaccaagggttccagggccacgttcgtcgtccctgggtgagtcgggtcctaaggcgaggccgacaggcgtagtcgaatggatgaacgggtcgatattcccgtaccggctttcggaccgaccaacagcccgtgtgaacaagggccatccgatacggttgatgggggcttcggcctcctgattccgttgctgtttggcctggacgcgcatgggttgagcgtttcaggagtgacgcggacgggtagccggccggggaggtggttttccctggtcaagcgtgtggccccgcccccaggcaaatccgggggcttcatggggtgaggcgtgatgatgggcgctttcatggcgtgatatccggtgatcccgtcggccgagaaaagcttcggcgcgaggtccgttgccgcccgtaccccaaaccgacacaggtggtctggtagagtataccgaagcgatcgagcgaatcctggtcaaggaactcggcaaattgctcccgtgccttcggcataagggagacccccggccgtgccggccccttgcgggtcgtgggcggctgggggtggcacaggccagggggtagcgactgtttaccaaaaacacaggtgcatgccaagacgcaagtcgccgtatatgcactgacgcctgcccggtgccggaaggttaagaggatccatcagcgtcccctcgcgggatgcgaagtggtgaattcaagccccggtaaacggcggtggtaactataaccatcctaaggtagcgaaattccttgtcgggtaagttccgacctgcacgaatggcgtaacgacttccccgctgtctcgaccaggagctcggcgaaattgcagtacgagtaaagatgctcgttaagcgcagaaggacgaaaagaccccgggacctttactataccttggtattggcatcaggtgcggattgtgtagcataggcgggaggcttcgaagccgcggcgccagccgtggtggagccggccagtgaaataccgctctgtccccatctgatgcctaacccggacaagtcagccttgtcggggagagtgcctggcgggtagtttaactggggcggttgcctcccaaagagtaacggaggcgctcaaaggtccgctcggcccggttggcaatcgggtgtcgagtgtaatcgcacaagcgggcttgactgcgagatcgacggatcgagcagggacgaaagtcggagatagtgatccggtgccggcgtacggacgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatcctgaggaggcctgcccatagtacgagaggacctgggtggacgaacctctggtatgccagttgtcgcgccagcggcacggctggttggccacgttcgggagggataaccgctgaaagcatctaagcgggaagcccgctccaagataaggattcctgacaccccccccgggggtgtgtgagaccccatagagaacatgtggttgatagaccggacgtggaagccccgcgaggggtggagccgaccggcactaacggtcgaagacaaccaacaccaccatgacgaagccggaaaaccccggcggcatcacggcggcacgaacaccaagtccctcactcgcgtccacgatccggttcccgaaccgccacccgcagacaggataacagattttgcggcggccatggcccaggggagacgcccggtcccattccgaacccggaagctaagccctggcacggcgatggtactatgcccgagaggacatgggagagtagcacaccgccgcaaccacacttcaccgaaggcccggggaacacacgttccccgggccttccccgtatcccgggcacaacgcagaacccccgacacggacaccgccgaaccgggggagcatatcacaccgcgcgatcttcatcccatgaacacccctccaaaccggaagaacaacaactccctactattttctcccaacctacatgcctctcctggggtcatttcataccttgccgggtcatcctacttctgctaatcatttgcaccgcgccgctgctcgcacatcttggcagacttgctgacgactttgtcagatccgaaatctactcccggcttaaccgtggcctgactcaggcaagatctgaatgcggcaagtgcgtgcagaaatgatttgattattgtaatacttgagcttaatactgtcttacgttggacaaggagtggttatgaacatgacatcggtcacggtccgggttgacgaggatacgaagaagcaggcttctgatatcgcagaggatttcggtttcgacctgtcgagcgtcacgcgcgcgttttaccggcagatcgtgcgtgagcgccgcatcccattgaatctgtcctacagcaatgttcccgaggaaacgctggaagcgttggctgaagcgcgacgcatggccaaggagggggcgcctcggttccaggacgccgacgcgatgttcgattcgctgggaatctgagcatggcgcggttggaagcggactacacatcggcttttcgtcgtgacgtcaagcggctagccgcgcaattgcgggcatgacgatccgtgaaatcagggaagcaaatggggttgcagatatgcgatatctgcaaccccatttgcctatgcgcgcggtggcgtgctcacttggtcgccgcgttgagcagcgcgtccacttcgttcatccacagcgtgctctgcgcatacgtcggcatcatgaaaccgtcgcgcaggtcgagtcccgccgagccgatacgcggaccgtcgggcaagctgtggcggaggaactgcgagccgaagaagcgctcgtagaacgccttcatccagccgggcagctcatgttcgccatactctccggcgaatgcctgcctggccagcgcaaacgttttcgcaggccggtattgggcgcgcaggaagccatccagatagaagtcctccacaaccgcaggcccgagctccgcgctttcgctcatgctcaccgtgtcatgttccggtatgtgcaactcgttgtcggggtcgcagatcgcgccgagcaacgtctgcagattcccgtctgcgcactcctgcgcatattgccgcggaatcaccggcacgaaggtgtgcgcaatctgcgaattgatgccatattggcggccgagatcgaaggggaactgcgtcagaccgagtgccagctgggtcatgtcgctcggattcacgataagccagctggtgtcgccgatcagctcctgaatatcgagcaccgggtgctccgggctgctctgtgcggcgttctgttgctcggcgcgggcggaggcgagtgtggcgaggggcaggccgagtgcgtccgccagctgttcgatgagtttcacgtttgcagattgcccgttttgcgcatcctgggagatcgccacgtacatgtcgggcacggcggggcgttccagatcgtagaatcgtgcgacggcgagcaccgccagcgctgtgttcgtcacactcgagttcgtggtatcgatgacgagatgatcggcattctgcgcgcccacgcgggcggcgagaccatgcgcctgcatcgtcacggccagcgagcagcagtctgcgcgcatcttctcatccgccggaatgaacggctgcttggagaccggccgcatgagcggatgatcgggaatggtcatgtcgaacatggtctcgtggtaatcggcgtattgcggggttggttccacgtggaacgacgacatgccacgacgtgcgccccacaggctttcgacgtccacgtcggcaacggcgaacccatctccgaatggctcggattgcgcgagaatactgccgttctcggcgatgatctcctggcctcccacggtcacgtcgccggtggaatcgccttgccccgaactgcagtaggcatagcagcacagcaagcgtgcactctgcccgctgatcagcgaacggcggtacagatccttttcgagtgacgcgttcgatgcaggaccgttgcagataatcatcgcgccggcaagagcgagatggatcgacgggggatcaggcccagatgtcctcgcaaatctcatatcccaggcatagctgcggcatctggcagcagcggaacacctgatgcgagccaaacggcacatgctcctggccggcgacggtgatataggtgacgtcggccggccctgaactgaaccaacggccttcgaaatcaacgccataggtgggaatgtaggtcttgggaaccacgcccatgatctcgccggcatggcaaatggcaagcgtgttgtagatcttgccgttcacgcatagcggcaggcccaccgagaatacgacgtccagcttcgcggtctcggcgacgagatgtgcaagcgtctcctcggcggcaccgagcacgatgtcgtggcacagcatgtcatcggcgatgtagctggtgagcaccacctccggcaatgcaaccaccttggctcctgcgttcgcggcgcggactatggcatcgcaacacagttcggcattggccatcggatcggcgacgcgtgtattcggcgatgcggtcgccacggggacgaagccattgttcataatcattcgaattccctcccgttctatgaatcgcagattatgcactgcggctcagcgtagtcgcgcgttctcgaggtcgggcgagaatcaggggcgaatatggtgaagtcggaagtggaaggtgttgtaagttgtgccgggcgcgatgcttgtgatggtgacggaagcgtgtttcgcccagccgcgtgaatgggtgattcgggtcttgggtgttgggttttcgacacgccggtggtggtgttgtgtttgttggggtttgggggtgtgtggtgtggggtggggttgcgtgggtgggggttgtggtgtaggtttttcttttgctgccgctcacggcctgccggggttcccgggtcggggttgtgggtgtgtggtggtggtttgagaactcaatagcgtgtactgtactacttgaccaaggttgatgtcgcttcggctgtcgtggccgttgtggttcttggtcgtcttttatgatgccagttccgttgtccgcctgcatggtttcgtgtgggtaatcctgtcgggttttgatggatggcggaggttttttgtgtggctccctttccttattagggggtccgtctgatttcttttgaaatggatttgagagtcgtttttggctttctgcaatgttttttgtggagggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctttctacggagaatatgggcgtgcatggttttgtgcacggttttgtggctggggtttgccgagtgcgatggtttgtcgtcgccgccctggcttgctggcgtggaagagtcgtattggattgtgtggtgtggtgcgtgctgttgggttccctggccgccaccggcccctggtgtggggtgtggttgccagtgtgtcccccaggtcggttgcccggtgcctgttggtgcggggtgggtgtcctggtggggtggtggtttgagaactggatagtggacgcgagcatcggcccgcccgttggggtggggttggtgttcgtactgtgattcggatccgaggaattgttttttcttgggttcgttcgtaatcgtatgggggcgtgccgtgtgtggtgcgtccccgtgatctgatgtcgttctagggtttttcagtagtgctttggtcatggcggccgtgttgtggttgtcgtgatgggcgtatggtggatgccttggcagacagtaccgatgaaggacgtgtggggccgcgatagtcctgggggagccgccgacatggctttgatcccagggtgtccgaatggggcaacccgccagccgtcatgggctggcaccgcacttgtgcggggggtacgcagggaagtgaaacatctcagtacctgcaggagaggatactccgtgagtagtggcgagcgaaagcggatgatggctaaaccgtgcgcgtgtgatacccgtcgggggttgcgcgcatggtgtcgtgggaacgcctgtccaacggccgacgccgttggctgtggtgataaatgcatgcgtgaggcgaaccgggttggataccgggccgtagagggtgatggccccgtagccgtatgcgcgtgcaccatggatggtgtctcccgagtagcgcgggactcgtggaatcccgtgtgaatccgcccggaccgtcgggtaagcctgagtatacctgtctgaccgatagcgtacgagtaccgtgagggaaaggtgaaaagcaccccgggaggggagtgaaagagttcctgaaaccgtgcgcccgcgaaccgtcggagcccccttggtggggtgacggcgtgcctatcgaaaaatgagtctgcgagtcagtggcatgtggcgagcataagccgtgtggtgtatgcgtagcgaaagcgagtcttaaaaggcgtcttttcagtcgcgtgtcctggacccgaagcgggatgatctagccctggtcaggttgaagcgcgggtaagaccgcgtggaggaccgcacccacttaggttgaaaactgaggggatgaactggggttaggggtgaaaggccaatcaaattccgtgatagctggttctcttcgaaatgcatttaggtgcagcgtcggttgattgcgtgtggggggtagagctactggatgcttgcgggcccgtgccgggtaccaacagcaaccaaactccgaatacccatcgcgtctattccggcagtgagtcggcgggggataagctccgtcgtcgagggggagacagccctgaccgtcgtctaaggtccccaagcgcgtgctaagtgggaaaggatgtggagtcgcatagacagccaggaggttggctcagaagcagccatccttgaaagagtgcgtaacagctcactggtctagtggttccgcgccgacaatgtagcggggctcaagcacgccaccgaagacgcggatgcggccgtatggccgtgtggtaggagagcgtcccacaccggggcgaagcggcgggggaacccggccgtggactgtgtgggagtgagaatgcagacatgagtagcgagagcagggtgaggatccctgccgctggaagaccaagggttccagggccacgttcgtcgtccctgggtgagtcgggtcctaaggcgaggccgacaggcgtagtcgaatggatgaacgggtcgatattcccgtaccggctttcggaccgaccaacagcccgtgtgaacaagggccatccgatacggttgatgggggcttcggcctcctgattccgttgctgtttggcctggacgcgcatgggttgagcgtttcaggagtgacgcggacgggtagccggccggggaggtggttttccctggtcaagcgtgtggccccgcccccaggcaaatccgggggcttcatggggtgaggcgtgatgatgggcgctttcatggcgtgatatccggtgatcccgtcggccgagaaaagcttcggcgcgaggtccgttgccgcccgtaccccaaaccgacacaggtggtctggtagagtataccgaagcgatcgagcgaatcctggtcaaggaactcggcaaattgctcccgtgccttcggcataagggagacccccggccgtgccggccccttgcgggtcgtgggcggctgggggtggcacaggccagggggtagcgactgtttaccaaaaacacaggtgcatgccaagacgcaagtcgccgtatatgcactgacgcctgcccggtgccggaaggttaagaggatccatcagcgtcccctcgcgggatgcgaagtggtgaattcaagccccggtaaacggcggtggtaactataaccatcctaaggtagcgaaattccttgtcgggtaagttccgacctgcacgaatggcgtaacgacttccccgctgtctcgaccaggagctcggcgaaattgcagtacgagtaaagatgctcgttaagcgcagaaggacgaaaagaccccgggacctttactataccttggtattggcatcaggtgcggattgtgtagcataggcgggaggcttcgaagccgcggcgccagccgtggtggagccggccagtgaaataccgctctgtccccatctgatgcctaacccggacaagtcagccttgtcggggagagtgcctggcgggtagtttaactggggcggttgcctcccaaagagtaacggaggcgctcaaaggtccgctcggcccggttggcaatcgggtgtcgagtgtaatcgcacaagcgggcttgactgcgagatcgacggatcgagcagggacgaaagtcggagatagtgatccggtgccggcgtacggacgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatcctgaggaggcctgcccatagtacgagaggacctgggtggacgaacctctggtatgccagttgtcgcgccagcggcacggctggttggccacgttcgggagggataaccgctgaaagcatctaagcgggaagcccgctccaagataaggattcctgacaccccccccgggggtgtgtgagaccccatagagaacatgtggttgatagaccggacgtggaagccccgcgaggggtggagccgaccggcactaacggtcgaagacaaccaacaccaccatgacgaagccggaaaaccccggcggcatcacggcggcacgaacaccaagtccctcactcgcgtccacgatccggttcccgaaccgccacccgcagacaggataacagattttgcggcggccatggcccaggggagacgcccggtcccattccgaacccggaagctaagccctggcacggcgatggtactatgcccgagaggacatgggagagtagcacaccgccgcaaccacacttcacaggaccccgaaccggcaccaccggctcggggtcctcgcatacccacaccccaacacacaaccaaaaccagcctcggtgttatattagataaatctgtgcaatctgcacaatatgccgtgcatgcggcacatcatatacaagagctgatggcgtgaacccgcagtatgtctggcattatgcgggcttgaaatcgccctccaggccaagaaagttggaccgggaacggtcccattcccatgagcacacgcactccggtggaatctgcgcaaaccaataccgagaatcctcacgcgtccaagtaatccaagcaatctcaaaacaatggtcaacagccagccaatgccggcccacgcgctttctttaggtcagttccccacagtcatatcacgcaatctcaatctgtcgatcatcgccacgggaatcatggcctttgtgggcatcctcaccgaaacgatgacgaatgtgctgctccctgtgctcatggggctgtttacagtctccacggccaccgtgcaatggctcaccaccgggtacctgctcatggtggcggtggtgatttcggtctcatcgtattgcaaccgcagattcacgaaccgagcaacattcatcattgccatggtgctgtgcatcgccgctctcgctgccattgcgccgacactgcatgccgacagcaatgcggtgttcaatactttgcagcagctcggcggtgtcgtgggcaccacagtgatggcgctctgcctgtccatcgtgcagttcggccatggcgaggtcggttcgcgggattacatggaggccaccaagcaaggcggcgaatgggcgctcatcgtcgtctccgtgttcgtgttcgtcgccattctcgccaacctgcgcgctttcctcaacgaacgtcgccagaatgtacgcatgcgctgagcgagcagtgcgcccacggtaagcgcggccgcctagtatggccttatgcactacttcacgccgaaacgctgcgagaccacgacgaagatcatgtaccatgatcggcaaaccgcgtggcaggcggccgaacagagccgtatcgagcgaggtgtggagctgtgggtgtaccagtgccagtattgcgggcaatggcatctgacgcaccgcgatcccgcgctcgcgcaggccgtgggccatttcaaacgctcgcagaagccatattcgcgcaagaagggtttcaagccccgtcgtcgctgaaatcagcagattttgcgatatcaacagattgtgcggtgtcggatggctcttttgcccaatcgcataccgtgctcaatctgccatgtgaggactttcgcgcggctcggttcacggaatcttccgtgtgatcgaccgcagacgccgtggaaaacggcgcattgcacggaagcttccgtgtgatcgaccggaaactgctgcctaagcggcatagtatgcggaagcttccgtgaaccgtgccgcggggtgccccaatatggtcggtttcacggaagcttccgaaaaacatgccgttttagactgccgcgctaacggcgctactgccgagctacttctctaggtcgaagccctgcgcgcgggcgtgctcgaagcccatctcaagcgcggcggtggacgtggccttcttcgtggtcatgtcgctgtacgcgcgctcggagagatccttgccgcgggtgtcatagtaggcctgcacttcgcggtcgtattcgcgaatgccgtccagaatcctgttcggctcggcgttgtacgaatcgtcgaagaactggatatcgcgcggcagacgcggcttcgggtcggggtgctggtccggcttgccgagcgcgaggccgagcacagggtatgtgtacttcggcagtgcgagcagcttgaccagttcgggaatattgccgagaatcgagccgaggatcacagtgccgagctcgaacgattccgccgccgtctccatggcatgcagtgcgagcacggcgtcgttctgtgcctgcgagaaacggtagctgttcttgagcgtgaactcgtcggaatccactgccacgccttcagactgcgcgatcaacgagttgcggtattgatcgagcacgaatatgtagagcacgggcgcgttcgcaatgtaatcctgattgcagatgcgcgcgatctcggttttcaccgccgggtccttgatgcgaatcgcagaccagtcattgagatactggctggatgcggtgttctgtgcggcctgctcgatggtgttgagcacatccagcccgatggcctcgtctttgaaggcgcgaatggagacgcgctcgagcagcacgtccacggtgtcattgtgaataatctttgccatagctcacattattcatggtgccgcgcacatgcacaacaacttagtcgattggcgcaacgtcggtcatgtcgctgcgcatgtgccgcatacggagacgcgctatttgcgcttgcgctgcagtctgcccacgatcgactgcgtgagcttgtcggaatacgtggtcacgactgtgctgaacgcagcggatgcggcggcgaacagcacgctcatgagcaggccctgtttgcggtccgcttcgtcgtcgttcgggctcggatgcactttgttcgtcaccagattccacaccgactggaacgccttgcccgccaccatgccgatcagtgcggggaatgccagtttgaatgccttgtctcccagcgtgtcggggtcgcgcatgcgctgctcgcgcagatcggtgatcttgttgttcaccttgtcgatccgctgcaccgtctctttcgtggtgttgtccagattcgcgagtttctcgttcgtgtcgcgtgtgtgcgccgactgcaccggtttcgccgtcgccatggacagatcgggcgctgtcttcaactttctagccatgtgcaccagtgtagagcacgcgcgggccgtacgcgcgcgggatattcgggcatgcgctcgcgtacggccgggaaacacggtaaagtgatgcacaagtttgttccctagagaaaagacggtgccgtcgtggaatctgcaggcaaattggtattgctccgccatggacagacggtgtggagccagtccggccaatacaccggccgcacgaacatcccgctcacgccggtggggcgcgagcaggccgctgccgcgggcgaacggctgcgcgccacgttccctaacggtttcacgccgagcaacatctacacgagcgatctggcgcgtgccatggaaaccgcagagctcgccggattcgcggagcacaacgtgaccgccgaccttgaggagtgggattacggccgcgccgaaggccgcacgcgagagcagctcaatgcggcggccggctatgagtggaatgtatggcgtgacggtccgcactcacttgatgagacgctgtcgggcacgcgcgtggaggtgttcgaagacggttccgagatcaccgtggtcaacggggagggcgaggccctggaggatgccgccgcacgcacccgcacggtgattgaacaggtgctgcctgccctgctcgccggggagaacgtgctgctggtggcgcatgcccatattctgcgtatcctgacgtcgcaatggctcgatctcgcgccggatttcggtcgcaagttgcacctcgacaccgcgcactacagcgtgctcggcatatacaagggcgaccatgtgatctatagctggaacagctaggttttggctgcagattgataacagcgacggcgtcggctggggccgggccgaaaggcttcgtcactggatcgctgcgcgcccttgacgttcctcagcctttcggcccggccccagccgacgcctcaccttttaatgctcgtttatggtttgggagcgcgactttccttacatttgggtgatgggatgtaatgccgagcgaagtgatggcccggagggcgggccggatagggttgaggaacgtcaagggcgcttgcgatccagtgacgaggccctatccggcccgccctccgggccatcacttcgcgactgcccttgcgattactgccgactcaggggagcagcatccagacggcagtgtcggcagacagcttgtgcggttcgtcgagcggctcggagctcaaaaccaccgtgcctgcgggcaggtcgatcggatcggggccaaagttgacgatgcacgcgaaggtgccatcgccctcacccgtgcaggggcgcgtataggcgaccacttcggcgttgtgggcgttgaaatcggtgccgggtagccacgtgatgtcgtcggtgtcgtcgctcggcgtcaggtgttcctggcggaattgcatcgcctgccggtacaggttgaacatcgaggtgtcgtcagccatctgcttgtcggcggcatactgcttgtaccacaacggctgcggcagatgcggatcggccggcgccgaaccgtcggccggggcgtccgagaacccgaacgaggctccggtgccgaacagcggatcccaatctgcaggccggggttcgtcgtcggcacgccatggcagtggcacgcggcagccatcgcggcctttctgtgcgccggcatggtcggtgtggaacgcgatcgggtcttcgagatgattccacggaatgttcgccacttcaggaaggccgagctcctcgccctgatacacgtacaccgagcccggcaggccgagttccatcaggatcgccgcacgggcacggcgcgcgccgaggtcgcggtcttcgatgtatgtggtgccgtcgcgcagcagccagtcgttcggcagctcgtgatagccggtggtgggcacctgcggcagaccgtaccggctggcgtgacgcaccacatcgtggttgctcatcacccaggtggtggtcgattccgcgtcgtgtgccgaccggatgccgtcttcgatggcgaccttgaacgccgccgcattccagttcgccttggcgaattcgaagttgaacacctgtccgagctcgccttcgcgcgcgtagaggtgctggtgctcgggaatcacccatgcctcgccgacggcgaagcgtgctggccggtattcattgaacacggcgttccattcacggtagatgtcgtgcacttcggcgcggtcccacagcgggttgttcccattgcgattgtcggtgtcgaacacgcagtccgcgtccatctcggcgaggggtttgctgtcgagatccttggcgaggccatgcgccacgtcgatgcggaatccgtccactccacggtcggaccagaagcgcagtgtcttcttgaagtcctcatgcacctcggggttcttccagttgaggtccggctgctccactgtgaagatgtgcagataccattggccgtcggccacgcgttgccaggccggccccccgaacagcgactgccagtcgttcggtggcagttcgccgtgttcgccgcgcccttcgcggaagatgtagcggtcgcgttccggcgagccgggttccgcggtcagtgccgcctggaaccattcgtgcatgttcgaggtgtggttcggcacgatgtcgacgacgatcttcatgccatgcgcgtggagcgccgtcacgagttcgtcgaaatcctcaagcgtgcccagacgtgggtccacgttgcggtagtcgatcacatcatagccgccatctgcaagctcggaagggtagaacggggagagccagatggcatccacgccaaggtgcttgagatacggcacctgttcggtgatgccggcgatgtctccgagtccgtcgccgttggcgtcgcggaagctacgcgggtacacctgatagacaacggcctgtttccaccagtcgtcgtgcatgttgttcgcggtcatggaagctcttttcttgtttttggaaacaaattcaggaaccattgtaataccgtttgcccggtcgccccgccgtgtcgtctggagacgtaatgctgtgcgaaacgcccatgtttgcagatcgtgagcaaacgcttgcatagtgcgtgtcgcagtgaaaagcgttgaaaataaagtatttttgagtcaatctgcacggcaatctccacaatttgtacgcaaacttactgcccacgtttgcaatctgctcaggaatgatgcataatgaaggggctacgaagtccgcgagggcgcggcttcaggaaaatacttcggtgccacttcggtgagtggctgaagtgggatgaggaaaggttcgaagatgaatcgcacagtgaaagcaacagtgggtctcgtggcgatcgccgcaatgtctctgaccggcttggccgcgtgtggcggaagcagcgcggacgacggcaagggcaaggtctacttcctgaacttcaagccggagaccgccgaccagtgggtcgcgctcgccaagaaatacaccgacaagaccggcgtgcaggtgaaggtgcagacggccgcctcgggcacctatcagcagacgctcaagtccgagctcgccaagagcgatgcgccgacgatcttccaggtcaacggccaggtggactaccagaactggaagggctacaccgccgacctcaaggacaccggcatctacaacgagctcaacaacaaggacagcgcgctgaaggacggcgacaaggtcgtgggcgttccgtacgtcgtggagtactacggcatcatctacaacaaggacctgctcaagaagtacaccgagctgccgggcgccaagatcaaggacgccaaggagatcaactccttcgacaagctcaaggaagtctctgacgacatgcaggccaagaaggaccagctcggcatcaagggcgccttcacctccgcaggcttcgactccagctccgactggcgtttcaaggcccacctggcgaacatcccgctctcctatgagttcaaggaggacggtgtgaccacgcagccggagacgatcaagggcacctacctgccgaacttcaagaacatcttcgacctgtacctcaaggattccaccaccgccccgtctcagctgagctcgaagaccggtaacgacgcgaactccgagttcgcactcggcgaggccgcgttctaccagaacggcacctgggcatgggccgacctgcagaaggccggcatgaagcccgatcaggtgggtatgctcccgatctacatcggtgccaagggcgaggagaaccaaggcctggccaccgccagttccgagaactgcctgtgcgtcaatgcgaaggcctccgaagccgaccagaaggcctcgaaggacttcctgaactgggtcgtcacctccgatgagggcatcaaggcgctgtcggaagacatgggcttcaccacgccgttcaagaccttcgacaaggtgaagagcgacaacccgctcgtcgaggaggccgtcgaggactccaaatccggcaagcagcaggtcgccgggaacttcacgatgatgccgtcggaggagtggcagaaccagctcggccaggccatgctcgcctacgcgcagggcaccggcagctgggatgacgtgcggaaggccttcgtcgacaactggaagaccgagtacgacaacgcccacgccaaccagtgagcgctgaatgggggcgtggattccgcgtccacttcttccacgtggaacccatgctgaataactagcgagaggagggccaccccattggggtggccctcctctttgtgtatatggactttgtgtatatggacacgttccttctcttgcattaaaaaagcttcctccctgcgtaaacggggacatattccggtgcggttttgtctttttacgcagaaagtgccgggatcgttcgctggcggggcataaagatgcgtaaaaggggacagaattacgctaattctgtccccttttacgtcgtttatcttggatcgcttactccctgtgcgtaagaggcgggggtgttgcgaagcgtcaggcgacgtgcttggcggtgctcgaacgcacgacaagttccgccggaatcgtgcggaacagatgctcgggcttctcgccctcgatgagcttgacggtcatttcagcggccatcttcgccatctcgatcggatcctgtgcaatcgtggtcagaccgatgtcgttcgcgtagaaactgttgtcgtagccgatcactgagatgtcgttcggcacctcgtacccgctgcgctcgagttggaagatgagcggcaccgcaatgccgtcctcctggcaggcaatggcggtgggcatgcgctcgaggctcatgaggtcggtgagtacgcggcgaatgcgatccggaccctcctgcgccacgatcacggtgggggagattcccgagcctgcacagcattccatgaacgaatcgaagcgctgctgcacggagaagtgcagtgagacgtcgcggttcgtgcgcacgtaggcgatgtcgcggtgccccagattgatcaggtggcgcgcggcgagaatggagccctgtgtgtcgtcgatgttcacggccgcggtgaatccaagctcgcgcggcatcaccgagttgatgccgatgatcggcacgttggcgctcgccagctgggcgatctcggtctcgtcggcgtcgaaggaggcgacgatcacggcgtcggcattgcgtcgtaccggcagcatctcgaagaaatcgcggcgttcctcgatgctggagatctggaagatcgaaatatcgtagccttcggcatgcagcaccgagttgaggccttcgatcacggacgccgagaaccacaggcgaatatggtcgctcatgagcagcgcgacgcgcatggcacggccggtcttgagtgcggccgccgagcgcgatgtggagaaattgagctcctcggcgatgcgcagcaccttctctcgtgtggccgccgacaccagctcgggtcgtgtgaatgaccgggagaccgtggaaatggagacgtgggctgccttggccacatcctgaatgcttgcgttcacctctgccctccttgttcgggaagcgggttgcctcgcttcgctcgactctatacagcatacgattgcgcccgttgccgccgcgtgtgcataccgtattgcaaacatgttgcatccacatggctgacagttaatccggcgagcggtcgcgcatgggcgggcgtcggtggccccagcggcatgatctaggatttgcttagacattttgcgcaaacgttttcaatatcaagtctacgctatgtgattacagaaaacgctggaaatgcagtaaagatctgtgatttgtgaaaagaagcattacattcaacacgacacgaatgcaaacgtttgacagaagatgacgatgttgctatcgtatgagtacaacggttctgtaatcgtttgcagtgactgcagatgaaccgggacatggcattgccccacagtggtgtggggcgaactcgaagaggagaaagtaggcatgctatgatcagcatggctggtaaggcaatcagacgatggtgggcgctgttcgtgctgccgacattcgtcgcgtttttcatcggcttcctggtgccgttcatctacggcatctacttgagcttctgctcgttcaccacggtcaccgacgccaagttcatcggctggcagaactacgcgcgcgccatcaaagacaaggaattcctgcacgcgctcggattctccacgctcatgacgatcgtgaccaccatagtgatcaacgtcgtcgcgttcgccattgcgtatttgctgacgaagtcgatccgcggttccaacctgttccgctcggtgttcttcatgccgaacctcatcggcggcatcattctgggctatatctggatgctgctgctcaacggcgtgctcgcccactgggagcgctcgctcacgtattcggcgaaatacgggttctggggcctggtgatcctcgtgtgctggcagcagatcggctacatgatgatcatctacatcgccggcatgcagtcgctgcccaccgatgtgcttgaggccgcggaagtggacggcgcgaatggccgccaggtcatgttccgcatcatcatcccgctcatgatgccgagcatcaccgtgtgctcattcctcaccgtgaccaacggattcaagctgtacgatcagaacctcgcgctcaccaacggcgctccgcagaacatgtcggaaggtctggcgctcaacatcacccgtacattctatggccgtatcggctgggagggtgtggggcaggccaaggccgtcctgttcttcatcctggtggccatcgtggcgctcatccagaacaagatcaccacttccaaggaggttgatgcgtgatgcaggagaaaccaaagcacggagcattgtggacgatcttcttctcgatgatctccattgcctgggtgttccccatcttcctggtgctgctcaactcgttcaaaggcaaggcatacatctcgcgcaacgccttcgcgttcccggtgggcgacacgttcgtcgggctcgagaactacaagcgcggcattgaatccacgaacttcttcgccagcttcggctggacggtgctcatcactgtcggctcggtgtgcctcattctcgtgtgcacgtcgatgtgcgcatggtggatcgtgcgcgtgaacaactgggccgccaagctgctctacaccctgttcctgttcaacatgatcgtgccgttccagatggtcatgttcacgctgtcgaagctcgccgacatgctgaagctcaacaccccgtggggcctgtgcttcatctacctgggcttcggcgccggtctggcggtgttcatcttcaccggcgtggtcaagggcatcccgcagtcgctggaagagtcggccatgatcgacggcgcctcagtgccacgcatcttcttccaggtggtcgtgccaatcatgaagccgtccatcgtctctgtggccatcctcgaggccatgtgggtgtggaacgactacctgctgccgtatctgacgctcgatctgggcaagtacaagaccatctcggtggccgtgcagtacctgaagggcggctatggctcggtcgacatgggtgcgatgatggcctgcctcgtgctcgcgatcatcccgatcatcgtgttctacctcatctgccagaagtacatcgtcaagggtgtcatggctggtgccgtaaagggctgacgttgagtcagcccttgggaaacagcgtggtgcgctgtttgcaggtgccagcccgagcggctgtgccgcgagggcggtgttgggtccggccgtaggccggtcaatacttgcagggcccgaggcggtgccgtaaagggctggtcttccttcctcttctctctcaaggcgactgggggcggctttcgggctgcccccagtcgcatatgccggcatgccggcctgattcacatcaaccagatttcccgaactgcactggagtaagctggtgcatgctatacgccggccagattgtgcccggcaccgacgaaagcgacgcagatgaaattcctgtctccagactccagattcatgcaggggtggaacgatctcaccgacgctatctggatcaacatgctcatgctggtcacatcgctgcccgtggtcaccgccggcgccgcgctgtgtgccggttccaccgcgctacgcaaatcgcagcgcggccagggcacggtcacgcgcaactatttcgccgccttccgcgagaatctcgccaaggcgacgctgctatggctcatcttcggcatctgcggcgccgcaatcgcctattcgtggatcgtgctgcagatcaccccactgctcattccgaaattcgcgctgacgatcatctgggccatcggcttcgaatgggcattctatttgcaggcgcgtttcgagaacccccttggccagaccctgcgcaacgcctacgtgttcggcgtcgtctacttccccgcgacgctcgcctgcgtggcgatcgacgtcgtgttcgtgggtctgctcgtcgccgcatggttctacatgccgcaggggctcttcctgctcgtcgtgctcggttacggttgcatgctcgcattgcacgtgccgattctcgaatacgcactgcgccggtacacgcggcaataggcgcgcgcatgtcgccggcagtcccgtgttcgacgtgtcgtgcgcgggcctgccgactcgtatccgtttcctagcggaatgcgctgccgattcgcatgctgcatctgcaaatctgctctcagattgatgatgcaatgttggattcgcgtgccgcttttgcgaatcagctcttagatcggcatcggcagcataaattaccgtgctggtcttgcgaacccatcttcagatgggcagccggagcgcgcattctcgtgtcgtatttgcaagtctgttctcatcatggttagggagggggcgattgctgtgtcgagactgcaagtctgccctcaccatggcatggaacggcgttgctggcaagccatgccgagactgagattgcaaaaacggcacgagaaaggcccatgggcgcggaacccatgggcctttcgcatatgcaacatacgcagtgtgatatgcagtgtgtatgcgcgcctactgattaatgcggttcatgatcttcgccagcgcctgcacgcgcggcgacttgaacacctcctgcgtgggcaccaccttgagatgctcgtcggcgagcggaatacgccagtttgggtactgcgtggacgtccccggctggttctgcgcgcgcgcctcgcccacgccgtccacgagcgcggcctgcagcagcagcgaaggcgcgtcggtgagcatggcgtgcatcgcctcgacaatggtctgcagattgtccggcacatcgtcggcggcctcctgactcatccagccgccctgcacgagcaggtcgagcatggcctgccgttcggcgagcgcggattcgcggaactcctccaccggctcggtgagcaggccgagctcctcgcgcagtttgacctgctcgagcatgagatagccggcggtcggcggcagatcgtgtgtggtgaccgacgaaagtgagtatgtgcggtacgtctgcggcatcgcgtacgggtcgccggcgttgggggagtcgtccacgcgggcgaaccactccaccgtggtgccgagcagcccgtgtcgtgcgagcacattgcgcacgaaatcgggcacggtgccgagatcctcgccgatcacgatgccgtttacacgcgtggcctcgatgctgagcaccgcgatcatcgcatcgtagttgtaggtgacgtatgcgccgcccttggcgccctggccggccgggatccaccacagccggaacagtccgagaatgtggtcgatgcgaatggcgcccgcatgttcgaacatgtggtgcaccatctcgcggtacatgcggtagccggtgagctcgagatagttcgggttgagcggaggctggccccaatcctgaccctgttgattgtagaagtccggcgggcagcccaccgtgacggagccgacggcgaagcgttccgggttgccccatgcgtccgcaccgtaggagtgcacgcccacggccatgtcctgcatgagcccgagcgacatgccagcgtcgcgcgcggcacgctgggccgcgtcgagctgctcctcggcgatccactgcagccagcaggcgaactcatacagatcgggatgctcggttcgcagcgcctggatgcgcggattgcttttggcggtcatgcggaaccaggagtccggctcccatggctccccgagcacttcgaatgcgacgctccacagtgcccaggtgtcgaggtcggcgccggccttctccttgaacgcctcgaacgacgcctgacgttccggggagcgcggctgcctgaagatgatttgcaaggcggcgcgtttcgccttccaggcggcgtcgagatccatcggcgacgattcggtgttcattggcgcgacctgctcgtgcaatgcgcgtacggcggcggcgtcctgctcgtcgagctcggcgaattcggcgatgtcctgcgggcgaatgtaggtggtgttgatgaagcggcgcgacatcggcgaatacggcgacggttcgatcgggctcaccggcgcgctcgcatgcaccggattgatgagcatgaagtcggcacccgagccggcggcgtccaccagcagttcgcgcaggtccccgtagtcgcccacgccccacgattcgggggagcgcaccgaatacatctgcgtcatccatccccagcgcttgtgcgaggcgagggcctcgggtaccggaatggatgccggcgcgcacaacagtgtgacgtcgacgtcgcgctcgctgcccgtttcgccatcgcgcacatgcagtgtgtggtagccgatctccagattgtcgccgatcgcgaggtcgtagacgtccacgtcgccatcatgctcgcggaaggtgagcgagagggcatcggtcgcgtcgctgccgtcttcgagcgtgagtccgatgtgaggctccccgtgcttggtgtgcagcggcgtgctggcgggggtgccgaggaacttgacgacggtgggcgccaccaggcgttcgtgcgcctcgttgcgtcgcgcgttgagattgatgtcgacgagctccggggtggaggcgtcgacgccgagcgcgccgagcaccgagatgagcactgcgtcgcgaatctccacataggtgccgagctggtctatgtagcaggtggccacaccgcaccccttggcgagctggatgagcggtcgtgcgagtcgctcggggctttcctcacggcgcgggggtgctgaattgatctgagacatgtcgttccttctgatatgggtcatgtgtgcgcagttacgtcattggagtgcgctgccgatttcagtatagcgtgctatgaaatcgtttgcaagtataacatgagggtgcctgtttcctttatattccgcgaagatatgcgaatgaacggaatttgatccatgtggtttttacgtgttcttcacgcccacgtttgcagactgtacccgccggctcggccggcagttggcgcgcgcatgggcggattcgccggctgcgccgtgcgtggctgcatatcgttgcggagcgcgatgacgagtccataccacgggaaggaggcgttggtggcggattatgctaccgattgcaaaagtcgggcatcagattgcactgaataggcaatgactacgttttcatccagcgctgaggggcgccggccgggcgactgcgtacgcccggccgggaccgtcactgcagcacggcgaaggattgcgggggcagcgtgagcgttgtgccatcgagtaccgccccaccaatgttcagcgtgatggtgcgcgtctcggagccgtcgtcatccggtagcgtcacggtctcgccgtcgcgccccggattgaccgccacaatggcggagacgccgtctttcgcgcgcttgaacacgaaggggcgcctgccttcctcggcgaacagcacgctgaagtccgcatccggcgcaaaggccggggtgctcctgcgctgttcgagggccgcgtgcatatggtgccagagcgagttgccgtcggcgacggccgccgcgactgtcggcgcgtcttcgcgttcgtccacgggcaggtagagggcgtcggcagcggcttgcgagaagccgtggttcgcgctgttgtcccactgcatgggcgttcgcgaacccgtgcgcgtgtagccgccctccttgccgggcaggttgcggtagcgcatgccgatctcgtcgccgtagtagatgaacggcacacccggcatcaggaagatcgtgctgtaggccagggccagctcgcgggtggtcaggcgcggcaccagacgcatggtgtcgtggttgcaggtgatgaggtcgaagtaggcatgcgccttgcgcgccgcttcgagccggggttcgtattcgccgaggaacggcacgatgctggtgccggaatcggcgttgaaatagctgtggtcgccatcgcggagcatgggggtgtcggtgtcgcgcagcagcatgctatagccgttggctacgccgtcccaacgccaatccaagtagaagtccatgtcgaagccggcctcgaacgcctcgtcggggcgtccccattccgagacgaatgcggcttcggggtactccccgcgaatctgtccgagcatgtactgccaggtgcggatcgtgtacggcttgccttcgtcgtcgcctttcaccaggctgtcggccatgtccacgcggaagccgtcggcccccatgtcgagccagaagcgcatcacgtcgagcatcgcgtcacaggtgcgcagcgcctcgtcgccgagtgccggtgcctgccagcctttgcgcgggtgggcgaaaccgtagttgagtgccggttggaatgcgaagaagttcacgatgtacgcgccgtcgcgcgcctcctcgccgccgatgaacggcagtccgtcgccgccctcgatccagttgccggtccagatgtagcggtcgtcgtacagattcggcgaatccgtggcgctttggcggaaccacgggtgctcgttcgacgtatggccgggcacgaggtcgagcagcacgtgcatgccgcgtgcgtgcgccgcggcgaacagtgcggcgagatcgtcgttggtgccgtagcgtgcggccactttcttgtagtcgctgatgtcatagccggcatcgcggaacggtgactcgtagagcgggttgagccagatcgcgttgcatcccagttgcaacaggtaatcgaggtgttcgatgatcccggggatgtctccgatgccgtcggcgttcgagtccgcgaagctctgtgggtagatctcgtagaacgtggcttggtcgagccattgcggaacctggtgactgctgctcatgccgtatctcctgccgtatatgccgggctgccgtgttgcagtccgtgccgtttcgtctgtttcatgcccgggattcgtcccgcggctgtttttgacaacgtttgcaactatgcgctacagtataaccactgagcgttgcgcgaaaccgttttcattgagagtcgttcaccgacgaaaatgactagactgtgaaacagtttcagggagactccccgaacgtgatgccgaggaaatgcacggtgttgcattgtaaggaaaggaagagatcgatgaagatcgaatggaagaaggcagtaggccttgcggccgctgtggccatgatcgtcccaatggcggcttgtggcgccaatggcggggattccaatgccgccgacggctcgaagccgtccgaaacgcagtccgcgaacctgaccgtatggggcccctccgaggattccgagtggctcaaggacatggaggaggccttcggcaaggcccaccccgaatacaaggtgacgtggaagaactccgtggtcgccgaaggtgacgcggccaagaccgtgaagaccgaccccaccgctgccgccgatgtgtacatgttcgccaatgaccagcttggcgatctgctcgaccagaacgccatcgccccggtcaacgacgtggtggcccagcaggtgaaggagcagaactcgcagacgatggtcgattcggtcactggtaccgacggcaagatctacggcgttccgtacacctcgaacacgtacttcatgtactacaacaaagacaagttctccgccgacgacgtgaagtcgctcgacacgatgctcgagaagggcaaggtcgcctacccgctgtcgaactcctggtatattccggcgttctacctcggcgcaggcatgacgatgttcggccccaagggcaccgacgccaaggccggcatcgacttcggcccgaacgccgacgccgtctccgaggcgctcgtcaagctcgtcgcgaacccgaacttcaccaacgacgacggcacgctcggcctcgcaggtttgaagaacggcacgctcgacgcctacttctccggctcctgggatgccgcgaacgtgcagaaggcgctcggtgacaagtacggtgcggccaccgtcccgaccttcaaggccggcgacaaggactaccagatgaaggccctcgccggttccaaggcgattggcatgaacccgaacacgaaggcacctgaggtcgcctcggcattcgcggcgttcctcggctccaccgaggcccagaagaagcactgggagatgcgtcagatcattccgtccgacaagacgctgacgaacctcgagggcatgtccacgtcgccgtacgtgcaggcacagcttgacacgattgcgaagacctccgtggcccagccgaccatctccgcgatgtccgcctggtggaccccagccgagaccttcggcaaggccctggtgagcaagcaggtcaacgacggcaacgtgaagcagaagaccgctgacttcatggcaagcgtgaagaaggacgtcgccaacaagcagtgatgccgctcagcacactctggtgactgggcggggcgtccggcccgatgccggcacggccgaacccggtccgtatatgtgcggaaagctgaggggaacctgggctttccgcacatttgctctgtgcgcaacgcacagacaatgcacattcaaatcactagttattcggattcccaatgccggttcggcgcctgcacgcaactgtcgcgtgaaccgcagagtcggcgccgtgcatggggcggtgcccctgcacatattttgagtttcagagaggcggttgaaaggaatgagtagttcagtagtcaccctttcaaaacgagagatgaagcgccgccagaagttgggtgcagactatgtggcgccatcgccatacacgctgagcgcagcgctgaaggacggcgatgtgttcacgaagctctccatcatcttcttcgggttgggtaatttcgcccgtcaccagattgccaagggcgtgatcttcctggcaggtgagatcggcttcatcgtattcatgatctatgccggcgcgcataacctcgcgatgctcccatcgctgggatggcgtcaggccagcaccgaatgggtgggtgccaagctggtccatacggccggcgacaactcggtgctgattctactgtacggcgtatgcacgctggtgttgtgcgcggtgttcgtgctgtggtgggatcttgcgatccgctcggcatacaaggcgcagtgcctcgccggcaagaacggccatgcgccgtcgttgctcgacgacattcacacattgctcaacgagaaggcgaacattctgttcctggcgctgccgacgctgggcattctgatcttcacggtgctgccgttgatcttcatgatctcgatggccttcaccagctacgaccacaaccatctggtgctgttcgactgggtgggcttcgagaacttcaagacggtgttcagcaattcaggcagcatcgtctcggcccgactgttcatgtcggtgctcggctggacgttgatctgggcgttcttcgcgacgttcctcaacttcttctgcggtctgttcctggccatggtcatcaaccgcaagaccacgcacggcaagggcttctggcgtgccgtcttctcgatgtcgatcgccgtcccgcagttcgtctcgctgctcgtcatgcaccagatgctccagccgcagggcgctatcaaccgcatcctcatgaactggggctggatcgacaatccgatgccgttcttcaccgatgccacatgggcccgcgtgaccgtcatcgtgatcaacctgtgggtcggcatcccgtacacgatcatgcaggtgaccggcattctgcagaacatccctgccgaccagtacgaggccgccgagatcgacggcgcgaactggtggcagatcttcacgaagatcacgatgccgtacatcatcttcgtgctgaccccgtacctgatcacgaccttcaccggcaacgtgaacaacttcaacgtcatctacctgctgacccgcggcgacccggcggtggtgggcgattcggccggcaagaccgatctgctcatcacctggctctacaagctgaccgtggacaacaacgactacaacctaggcgccgtcataggcatcatgaccttcgtcgtgctcgcggttgtgtcgctgatcacctaccgcagcagtggttcgtacaagaatgaggaggcattccggtgagtaatgcaaccaaggcgcagaccaaggcctccgaggcgtatgtcgaggccatcgacaagcgcgtcgattcggagcttgcagagtcgcacaacgcgcaacgacagagtttctggaaggatcagaagtcacgccgcattctcggcgatgtgctcacatacgtgctgctgaccgtgctcggcatcatatggctgttgccgatcgtatggatcttcctcgaaagcctcaacaagaacacggccccgttcaccgacacgttcttcccgacgcagtattcgttcgacagctacgtcacgctgttcacgcagcgcaacgtactcgacttcccgcgcatgttcatgaacacgttcatcattgcagtcttcacctgcatcatctccgtgttcttcgtgctctccgttgcctacgtgatgagccgcatgcgtttccacggccgtaggttcttcatgaacttcgtgctcatcctgggcatgttcccgggcatcatgtcggtggtcgccatctacttcattctcaaggcgatgggcctgaccagcagcggcacgacgatcctcgcgctcatcctggtctattcggccggcaccggtgcgggcttctacgtgatgaagggctacatggacacgatcccgacctcgctcgacgaagccgccatgctcgatggctgcacacgttggcaggtgttctggattatcatcgtgcctatctgccgcccgatgattgtgtaccaagcgatcgtcggcttcctgaccccctggctcgacttcgtcatggcgaaggtgatcgcccgcacccaggagaactacacggcgtccctgggcctgtggctcatgctcgacaaggagtacatcaacaactggttcggtcgcttcgcggctgccgcagtgctcatctcgatcccgattgcgatcctgttcatcgtgatgcagcgcttctaccaggagtcgatgtccggttcggtgaagggatgacgacatggcgctcgcacggcaatccgaaggattgaaggcgggtgtcgcagaaccgttcccactgagtctggaacgtgaactgggtgccgtggcgaacgaccatggcacccagttcgcaatctgggccccgtcggcgaagtctgtgacactgcgcttcttcaccaaaggttccagcatggaggacggcgacgccatggtgggcgcccaccggcccgaactgcaaagcgacggcgcgtggacaatccatttcgacgggaacctgcacggcacctactacgactacttggtggaacaacaggatggcaaccgggtgcgcaccgccgacccgtgggccaaaggcgccggcgtgaacggccggcgcagcatggtggtcgacctcgcacgcaccgacccggccggctgggagcatgacacgcacccgatcaccccgctgcgcgagacgatggtggccgagatgcatgtggccagcttcagcgcgaacccgcatggcggtttcccgctcgagcaccgtggcaaatacctggccttcaccgacctcggcaccaccgtggacggcaaaggggagttccccacgggcgtcgactacttcaaacagctcggcgtcaccgcgatccagctgctgccgttctacgactacggctccgtggacgagaacgacccgaggcagtacaactggggctacgatccgcttaactacaacgtccccgaaggctcctactcgacgaatccgttcgacggcaccgtgcgcatcaccgagtgcaagcagatgatccaatcgctgcacgctcaaggcttcaaggtgatcatggacgtcgtgtacaaccacatgtacacggccgacaactggttcgagcgcgtggtgtccggctatttcgtccgacgcaatgccgacggcacgttgtcgaacggttccggttgcggcgacgacatggccagcgaacgcgcgatgatgcgccgctacatcgtggactccgtcacctactgggcgcgcgaataccacatcgacggcttccgcttcgacctcatggggctcatagacaccgatacgatgaacgccgtgcgcgcctcgctcgacgcattgcccggcggcaaggacctcatcatgtacggcgaaccgtgggccgccgggccgagctccacgctgcccggcaccgagcttgcgaacaaggagggcctgcatctgctcgactcgcgcatcggccatttctgcgaccgaacgcgcgacgcgatcaagggccatgtgttcgaacgccggatcaaaggctatgtgaacggcaacgcgcacgacaccaagccgcagatcgagctcgccgtggacgcatggcgcgcgcccgagaccaacgaaggcaacgccgggcagatcatccagtacgtctctgcccacgacgactggacgctgtgggacaagctgtgcctgagcatgatcggcgacgactcgccggaatctgcgaataaggcggaatccgggcatgccgatgactcgcacagaacgctggaatctcgcgacgacgcgctcgaacacgcctaccgcgcgatgccgggcacgcagacgcgcaaggtgctcgaggcgaacgcgctcgccgccggactcatctacacggccgcaggcatcccgttcatgctcgccggagaggaattcggcaagacgaagttcggcaacgacaactcgttcgactcgggcgtcaaggtgaacgaactcgattgggcgcgcgccgaacgcatgcagggcctcgtggactactaccgccgtctgatcgccgtgcgtcgcgcgaatccgggcctgttcgacgccgagcacatcgccgtggaggcgccgggcaacgcggtcgcctaccgtagcgacgacatcgccgtgctcgtcaatccggacgacgaggagtacagtctgcccgtcgagcgcatcgattccgcgtttgccgacagtctgcatgacgatctgcccgcaacgccggaatctgcgagccatgcggaagcgcggtgggtgtgcgtgctcgattcgagcggcacgtcgaccggagaattccggcagacgggcatacggatcgccggcggaggattcccgatgcccgctcgcacactgagcatatggaaacgtgaacgctgacggaggcggcatgacgcactacacaaccgtgttcttcgacctgtacggcacgctgatcgacatacacaccgaggaggattccgacgccgcgtggtccgcattgcgggcggcgctgtaccaaaacggcgccgactacgccacgaattcgcaactgcgcaacgaattccgccgtcaggtggtgcgcgccaacgcgacgcgtgcgcgcacggagtggttcgagccggacttcctgcccgcctaccgcggtctgctcgaggcatgctgggccgacgacagtctggtgcacgcgcgaaaggcggcgtgggcattccgccgcgccgccacgacgaagttccgcctgtacccaggcgtcttcgacatgctcacgcagctgcgtgcggcaggacttcgagtggcgctcgtttcgaacgcgcaggcctgctacacgcggccggaactcgagctgaccggactcggcgacgtgttcgacgaagtggtcatctccagcgacgaaggcgtgcgcaaaccgtccgccgaactgttccgcagcgcgctcgtgcgcatgaacgtggagcccaaacatgtggtgatggtgggcaacgatccgcgcaacgacatcgacggcgcgcgcatggccaacatcgacggcatctacctgcataccgacaatcacacgccggcgcagtgcgacaccgcagtctgctcgctcgaaggcgccgattacgcgggcgtgctcgcctacatacaacgcgccaacacggaagacgggcgtgggcgcgaatattcggatactctggaagagaagctcagataacagacgggaaccggcatggtagacgaatacacgcgccacttggagcgcaacaaagaggtgaagggcaaagggctctcgcagttccgcatgaaggtgcttgccgatgtgctgctgttcttctccccgttctcggtggccgtgctcccgcacatcgtgggcacgccgagccgcgagaacatgttcgcgctctccgtctgcgtgatcggcgaggcgatctcatgggcgtcgatcccgatgttcgcgtggctgctctaccagggattcgaatggacgggcaacgcatggctctacgggctgcgcctgctcgtgctcgcgctggtgtgcgaggtgccgtacgactacgtggtgttcggcagcgcgttcgacatgcgctcgcagaaccccgtgttcggcctcgtggtcgcgctgatcgtgctcggcatactcgacctcatgtacgcatggcgcacgagtgtgctcaaggtggtgctttcggcaggtgtgatcatcatcggcctgctgtgggatttcatgctgtcgatcggccagacgcagcgactcatgaacgtaggcattgtgacgctcggcatgtgcgtgacctactactacctgcattcccgtgagaacacgatggtgttcacggcagccatattcggagcggcctgcgtattgacgcctggcttgggcgcggtggcgctccactaccgcaacgacaagctcggctatacacaccggtggacgcgttgggcgttctacccggtctacccgatcatgctcgtgctctgcgcggcgatcggaatggcgaattaatctgccgcaaagctgcggcagccatataaggagtacgaaatgcacaaggctggaattcgtgacgtggcacgggaggcgggcgtttccatctccaccgtctcgcgcgcattcaccaagccgcagctcgtctcgcaagccacccgcgacagggtgatggctgctgcaaacaagcttgacttcaacatctcacgctcggcgatggcgctcaaatccgggcagacataccgcgtagcgctgctcatgagcgagggcatcacgagctggttcaatgccgaggtgttcgccggcatagacgatgtgatgcatggcaaaggctatgacatctcgctctaccagcacatcaacgacgccgagacgcgcgaccggttcttcaccgtgctgcctgtgcttcgcaacgtggacgccgtgttcgtggcatcgttcgcgatagagccggcggagatcgagcagttgcgccgtacgaaggtgccgatcgtcggcatcaacacgcccgacccgctccgtttcgacgcctccgagaccatcgacgacgaaggcggcatgtaccgggcggctcagcatatgatcaaactcgggcataagcggattgtctacacctgctcggcggcggccgagacactcgacgcgtcgatagacctgcgtgggcacggcttcatacgcgcatgtgagcgtgcacagaacacgcacgacatcagctggaaggtgctcacggtgccgcgcggccgcgatttcgccgacaatgcgctcaccgcggtgctgagcgaggaccggttccccgatgcaatctgctgccagatggacatgatggcgattccgctcatgatcaagctggctaggcacggctacagggcgccgcgcgactattcgatcatcggattcgacgacgccccgtatgccgacacagtggagctgacgacgatgcggcagaacccgtacgagatggggcgcaatgcggcgatgaaggcgctgacgctgctggagggccgcgctctggagcagccgcatgcgattctggagccgaagctcgtgctgcgcggttcggattcgcggtacgagggggagtgagcgcggatttgtgtgccgcttttgcaattgcagtctcagactggcgattgcggagcattttgtggtgctttgccgagaccggagttgcaggaaaggttatctgaagacttgtgagattgccatgtttgcaagtcctgtctcagcggggcatgggaggcgcgtcttagcatgcttgctttgcaaagacagtctcagattggttattgagtgtgcgatgccgtgctctgccgaggtcagggatgcaagcggggtcatcgaggagcgcgcagatgtgctacgcttgcaatctcggtctcaaaaagaccttctcggcgtatctaccgtgtttcgacgagattgagattgcaagcaaggtcatcgggggagcgcgtaatcgtgccgaatctgcgactccggtctcatgaaggtgcgcttggtgagatttggaacgccctgttgagatggagatgcaaaacgagtcatgcagattcttggacgccgcttgttgcggaagtcacccactgcaatctgggcgtttgctgaaatatctctttttggaatctggaaagcgttggaaatccgcggatttcagggcgtctggaaaaatgtgggtttttttgttctgcaatgggaataaaggatggaatgaaatacttgagtgatgtaggctcaagttttagaaagcctcaagagaggtcgcccaacagcggccggctcgacgggcttgagcacggaacgtaacacgaatagtgaataacaaaaggagatacagtatgggacgcgcagttggtattgatttgggtaccaccaattcctgcatcgcaacgctcgagggcggtgaaccgaccgtcatcgtgaacgctgaaggtgcacgcaccacaccgtctgtggtggcattcagcaagtccggcgagattctcgtcggcgaggttgcaaagcgtcaggctgtgaccaacgtcgatcgcacgatcagctccgtcaagcgccacatgggcaccgactggaccgttgacatcgacggcaaggaatggactccgcaggagatttccgcacagatcctcatgaagctgaagcgcgacgccgaagcttacctgggcgagccggtcacggacgccgtgatcacctgccctgcatacttcaacgatgcacagcgccaggcgaccaaggacgccggcacaatcgcaggcctgaacgtcctgcgcatcatcaacgaaccgaccgctgcagctctggcctacggtctggagaagagcaaggaagacgagcgcattctggtcttcgatctcggcggcggcaccttcgatgtctccctgctggagatcggcaaggacgacgacggcttctccaccatccaggtgcaggctacgtcgggcgacaaccacctcggtggcgacgattgggaccagcgcattatcgactggctcgtcggcgaagtgaagaacaagtacggtgttgacctgagcaaggacaagatcgccctgcagcgtctgaaggaagctgccgagcaggcgaagaaggagctttcctcctcgatgtccaccacgatcaacatgcagtacctggccatgacccctgacgggaccccggtgcacctcgacgagacgctcacccgcgcccacttcgaggaaatgaccaaggatctgctcgaccgctgccgcacgccgttcaacaacgtgcttgcagacgccggcatctcggtctcccagatcgaccatgtgattctggtcggcggctccactcgtatgcctgccgtgaaggagctcgtgaaggagctcgacggcggcaaggaagccaaccagtccgtgaacccggacgaagtggtggccatcggcgctgccgtgcagtccggcgtcatcaagggcgaccgcaaggacgtgctgctcatcgacgtgacgccgctgtccctcggtatcgagaccaagggcggcatcatgacgaagctcatcgagcgcaacaccgcaatcccggcgaagcgttccgagatcttctccaccgccgaagacaaccagccgtccgtactgattcaggtctatcagggcgagcgtgaattcgcccgcgacaacaagccgctgggcaccttcgagctgaccggcatcgctccggctcctcgtggcgtcccgcagatcgaggtcaccttcgacatcgacgccaacggcatcgtgcacgtctccgcaaaggacaagggcacgggcaaggagcagtcgatgacgatcaccggtggctccgcactgccgaaggaagagatcgaccagatgatcaaggacgccgaggcccacgaagcggacgacaagaagcgtaaggaagacgccgagacccgcaacaacgccgagaacttcgcataccagaccgagaagctcgtcaacgacaacaaggacaagctctccgatgacgtcgcgaagtccgtcaccgacgcgattaacgagctcaaggatgccttgaagggcgacgacattgagaagatcaaggccgcccaggagaagctgatgaccgaggctcagaagatcggtcaggccctctacgcccagcagggtgccgaaggcgctgcaggcgccgccgacagcggctccgcgaacaacggtggcgacgatgacgtggtcgacgccgaggtcgtggatgacgacgacaaggacaacaagtaatgtccgacttcaataaggacgattacctgaacgacctgcccgacgccgacgaactggcgaacgggcaggcgtcccctgatgccgatggcgccgatgcgccatcggacaccggcgagcagctgaaagacgacatgctcaaggatgccgccgcggagcaatccgcaggcgaacaggcctccgaagagtccgccaaggcagctgccgaagccaccgcagacgccgcctccgatggcgacgctgagggttcctcgctcacaccgcttggccaggccaagaaggaagccgccgaatacctcgaggcgcttcagcgtgagcgcgcggagttcatcaactaccgcaaccgcacgaagaaggacatggatcgtgcccgtcagcagggcatcatcgatgtgctcaccgcaatgctccccgggctcgacgacatcgaccgcattcgcgagcatggtgagatggacgattccttcaaggccgtggccgcgaagatcgacaagaccttcgagaagttcggcgttgagaagttcggcctgaaaggcgaggacttcgaccccaccaagcatgaggcgatcctgcacaagccggatccggaggccagcaaggcgacggtggacaccgtggtcgaggccggctaccgcatcggcgaccgtgtgattcgcgcggcacgcgtggtggtcgcatctccgcagaactgacgcccgtgcgagatggccgtgaaccgcattcgatttacggttcacggccgtttttcatgcatgggtatttccatacagactttttgacgaatacaacccagactttagcctcgaaaggaggcacagcagcatggctgagaatgattggctgaacaaggatttctataagaccttgggtgtctccaaggacgccgacgagaaagagatcacgaaggcgtaccgcaaactcgcccgcaagtaccatccggacatcaacaagacgaaggaaggcgaggagaagttcaaggacatctccgaggcctacgacgtgctcaaagacaaggattcgcgccagaaatacgacgcaatccgctccttcggcgcaggtggcgcacgcttcactggcggtgccggcggcggcggattcaacgccggcgacttctccgacatcttcggctccatgttcggcggtggcggtggcaacggcggttcgcatatccgcttcagcacgaatggcggcggctcccatggcgcagggttcgacgacatcttctcgatgttcggtggcggagccggcaacggcggctttggaggaggccgcggctacggggactatagcgatggagcctacgcaggctaccgtcccgccccgcatcccgaggatggcgacgacctcagctcgaagatcacgctcacgttccgccaggccgtcaagggcgccacggtctcgctcaaggccgcgggcaagaagttcaaaacgaaggttcccgccggcgtgaagaacggccagaagatcaagatcgccggcaagggcaagccaggccagcacggcggcaagccgggcgacatgtacctgacggtcaccgtgaccgaagacccgaagttcacgatggacggcaaggatctcgtgatggatctgccgatcaccgtgggccaggcggtcgacggtgcgaagatctccgccagggacttcgacggcaatgacgtcacgttcaaggtggagaagggcacctcgagcggcgaggaagtgcgcgtgcgcggcaagggcgtggagacgcgcaccggcaccggcgacctcgtcggacgcattcagattcgcgtgccgaagcacccgaccatgggcgagaagcacgctgcgaaggaattcgacaaggcgtgcggcgacttcgttgaggagctcgccacagagaacaccgaaacgaagtgatcacaatgacgcgcatatcaccagcacggcgcaggctgtatgaaatgtgcgcgacggccatcgtggccaagcgggccaatctggaaggtgcggccggtgtgggattcgacatcgacctgcccgtcttctcggtgggcaaggtcggtcagatcgccgagattcacccccagaccctgcgtcaatacgaccggcaggggctcgtggtgccggggcgcacggaaggcggttcgcgacggtactgtctgcgggacgtcgaccggctcgtgcaggcgcaacacctcagtcaggacgaaggcatcaatctgaacggagtgatgcgcatcctcgaacttgaggaggagaaccggcaactgcggcatgaagtgcaggaactcaccggtgtgaccggattcagcgtgttcaccgccgacatgaacggcagcatcacccagacgtcgcgttcgcatcgcgcacgctattggcgtgggcagctccatgccgaggtgcacgcattgccggcgggggagagctcaagcgcgcagtcgaaatcgatggtgttgtggcatacggccaagcactgacagcaatccttggcggccagatgtttttcatctggccgctttttgcgttatgcgcctaggctatgctgggccggacgaggaaatctgcgaataaggagaggcgaatgatgctcaaggcggtgttctgggacatggatggcacgctcatcgactccgagccgtactggcatgccggcgagatgcagatcgcgcacgagaacggcggtgtgtggaacgacgagctcgcatggaacggctcgggccgcccggtgccggatgtggcgcgcgagatcgcggagcacgggtgcacgctgccggtggaggagatcggccggcgcatgatcgaatacgtgacgcgggcggaatatgagcggatcccctggatcccgggcacgcgcgagctgctcgtcgcactgcgcgacgcgggtgtgccgagcgtgctcgtgacgacatcgccgcgcaatctcgccgagaatctcattgcgcaggctcccgcaggcacgttcgccggatatgtgtgcggcgaggacgacgtggccaagaagccggatccggcaccgtatgtggaggcggcgcgcagactcgacataccgcgtgccgatatgccgcagtgcgtggcgttcgaggactcgatgagcggactcacctccgccgccgcttccggtgcgacgacgattgcgcaactcggcttcattcgcaccgacaattcggacggtccgcagtacatgtcgattgacgggtacgacggcgtgacaccggagtcgctgaatgccgtggtggaacgtcggattgcggaattggccgcgcgctgagcgggcaatatggtcgttcggtgacgcgtgtgtgcggtaaacgaccgtacttggggagattatggtcgttgaggtgacgcgttgctcactcaacgaccatatgcggctcttgggaatctttatagggtggcttggcggaatgccggcattgatggagattgctggaattggtcgtcgccccacctagactgggagaggcttcgtctgtgcggcggggtccctcgtatgtgcgacgcgcggaaatggtggaggaacatggctgaacgaccggaaacgcaagagaaacgcaaggtgattctgcgtgccgcgaccgaggtgttcggtgagaagggtgccacgaagggcacgttggaagacatcgccgagaaagtgggcatgacccgcgccggcgtgctgcatcactttggctccaaagacaatctgttgctgcagacggtgatctaccgcgattcggtggatctcgaggattacccggaagatatggcgcgcggaggcatgcccgaggatggcgccatcacgttccgccatctcatcaagacggcgaaggcgaacgaggcgcgcccgggcctggtcaaggcgttcattgcgttctgtgcggactccattcgcgaagacagcccggcgtacgactacttcgtctcgcggtaccgcaatctgcggcgcatgcttgagaaggcgctgcgcatcatggccgacgaactcggcaaatcggttgacgacgccacgatctgcaacacggcgatgtcgattctcgcagtgatggatggcttgcagattcaatggatgctcgacccggatgcgattggattggcggaggagaccgaacgggcgatcaaactgatgctcgccggcgcgcttgacttgaacgacgaggaacgcgacgcgattctgtgactgtcgctgtgttgtgcagcgtgacgaatatggagctttcgtcggtttgcgcgggtggttactcgacggtacggtatatgctgggatatgcgtcttccgcgaatttcgatgaggaaattgttatgacttcacgtgaaacaaatacgccatatctggattcgtccctgccgattccagcgcgcgtcgccgacctactcggccgcatgactctcgaggagaaggtggggcagatgatgcagctcgacgcgcgcagtggcgagctctccgatctcattgtggaccgccatgtggggtcgattctgcacacctctcccgacgatctcgtgcgtgcggcgcggatagtacgcgaccagacgcgtctgggtattccgctgctcgtcggcgatgactgcattcacggatattcgttctggccgggcgccacgatcttcccgtcgcagctcggcatggcatgcagctgggatccgcaggcaatcgaggatgccgcccgcgtgaccgccgaggaggtctcctgcaccggcgtgcattggacgttctcgccggtgctctgcattgcgcgcgacacccggtgggggcgtgtggacgagacctttggcgaggatccggtgttgattggtgagatggcatccgccatggtcaagggctaccagaagaacgctgccgcgggcgagaccttcgccgacgatgcgattctcgcctgcgccaagcatttcgctggctattcgtacacgcagggtggccgtgacgcctccgaggccgatctgacgcatcgcgcgttggaaagctggtatctgccgccattcgagcgtgtggccaaggagggctgcgccacgttcatgctcggctacgagtcaatcgatggcacgccggtcacgttcaacaattggctgctgaaccgcaagctgcgcggcgaatggcagtatggcggcacgttggtgaccgattgggacaatgtgggccgtgccgtgtgggagcagcacatcaagccgaactacacagtggcggcggccgatgccgtcaaggccggcaatgacttgatcatgacgaccccgggcttctatgagggtgccatcgcggcggtaagcgaaggtctgctcgacgagcgtctgctggacgacgccgtggcgcgcctgctcacgctcaagttccagctcggtctgttcgaagatccacgtttgcccgatcgcgcgcgcatcgacgcggtgattgggtccgcagaccatgcgcggcgcaatctggagatggcgcgtgaatcgattgtgctgctgcgcaacaacgctgtgctgccgttcgcagatgccggtgagctgcacaggatcgcagtggtggggccgctcgcggacgatgcgcagaatcagctcggcgattgggcgggcaactcgggtcaggtgccgtggatgccggaaggccagccgcgcgagatgatctgcacggtgctcgacggcgtgcgcgagctggcgcctgcagattgcgagattacgtatgcccgcggcgcgaacgtggtggatctggtgccggacccggaaggcgagctctacccggatgggcagccgcggccgaagatggcggtggccgcgaaaatcgaccagcgactgctcgacgaggcggtggaacaggcgcgcgcggcggacgcggtgatcgcagtggtcggcgacgttgtgcagctcgtcggcgagacgtgctcgacggcgacgctcgaactgcagggcggccagaaccgtctgctggaggagctcgccaacgttgcacgtgaaacacataagccgctcatcgtcgtgctcgtcagttcgaaaccgcaggtgctgccggcgtgtgtgatcggcgagaacggcgtgattgtcgacgaatccgcggcggacggtctcggcgcgctgctgtgggcggcgaatccgggtatgcagggcggccgtgcgattgccgagatcatcttcggcaagaccgagccgagtgggcgtctgccgatcacattccctcgccatgccgggcagctgccggtgttctacaacgagattcgcggtcagcacggcaatcggtacgcggatctgacccaggatccggcgttcgcgttcggcgagggcctctcgtacacgacattcgaatacggagatccgcagattgtgaacggttccgaattccgcgcaggtgacacggtgcgcgtcgaggtggatctgacgaacaccggcgcgcgcacaggaacggaggtcgtgcagctgtacatcagcgacgtcgtcacatcgttcacctgggcgtgcaaggagctcaagctgttccggcgtgtgacgctcgagccgggggagacgcggcgcgttgccttcgatctgccggtcgattcgtgcacgattgtgaacggcgatgcggagcggatcgtcgaacccggcgaattcaaggtgctcgtggggcattcgagccgcgacgagaatctgcggcaagcgacgttcaccgtggtggaatgagtgcgtttccatgcccgcatcagccctctctcagagatgatgctgatacgggcggctcattcatgtattttctgctacagtgtgctcatgccgtacgatgtgaagcgagaacagaagaacctgtatgtgccgggcaagacgcccgcaatcgtcgaggtgccggcgatgcagttcgtggcggtgcgcggggcgggtgacccgaacgatccgcacggcgaataccagagcgcgctgcagctgctgtacggtatatcgttcacaatcaagatgagcgagaaatccaaggattcacgtgatcacatcgccgggtacatgccatatgtcgtgccgccgctggaaggtctgtggtggatggggcggaacgcgagtgagccggtcgattacgcgcgcaaacaggatttccaatggatttcgatgatccgcttgcctgaattcgtcacagcggacgcgttcgaacatgcgcgcggactattcgcgaacaagcaccccgaggcggacgtgtcacgcgcgcggctattcgaatatgacgagggattgtgtgcgcaggtgatgcacgtcgggccgtatgacaccgagcctgcgacaatcgccgccctcgacaagtttgtgggtgagcatgggtatgcgctggatttcagcgatgcgcgccaccatcacgagatctacctgagcaatccacagcggtgcgctcccgaccgtctgcgcacggtgatccggcatcctgtgcgcatggcgtctgagtgagggagcgcggttgtgtgcttatacgtaaagaaaaaggccgctgcggtggaatgaatgcagcggccttagtggagctgatggtaatcgaaaccacgacctcttcgatgcgaacgaagcgctctaccaactgagctacagccccaatcttcaattatgtcgtcttccgacaactcgtccagtttagcccaaccccttcccaaatgcaaattcctccatgcgtgcgggtttcggatagtgcctcgcagttgccttgcgaatgctttgggccagtgcggagcctcttttggcgttcttcgttggccatgctgtgcggaatcaagcaccgtgctcgatgttgccgtcgagatcctctacgagaggcgtcgcctctttctcggcgacctcggccatcgcgtgtgccggcgcttccttcttgccggtcttcgccttgatgaggccgacgaaagtggggatgagcgagatgacgagaatcgcgacgatcacgagttcgaagttgtcttgcaccaccggaatgccgccgaagaaatagccgagcagcgtgaacagcgacgaccagacgagaccgccgagcaccgagaacggcgtgaatctgctccaacgcatgcccgagatgcccgagatgaacggcatgaacgtcctgatgaacgggaagaagcggccgaggaacacggcgagcgggccccagcggtcgatcatcttctcggttttggccagacgttcgggggtcatcgccttgaccttgccggattcaatgatgcgccggccgaagaagtggccgatgaagtagttgcattggtcgcctagaatgggggcgagccataccaccggcagcaaggcggcgagcggcagtgcggatttgccggtcgccgcgtcgggcgccgcgaagaaaccggcggcgaacaacaacgagtcgccgggcaggaacgggaagaagaccacgccggtctcaatgaagacgattagaaaaacaaagccaagtgttggcgccacgcccattgcgatccagccggcgatcgccgcacgcgggtctttgagcagattggcaatgaattggatgaatcccatggattgaatgtcctcttcgataggtcgagcggtgtgtgcttctcaatctccttgattattcatagcacaggtaggcaaccatgccaatgaggaggtgcgtgggtcgagagctgggaaggtggaggtgacggcgatgccatccgctcggttgcgtaattggagacgtttgcgtctggaatctgtctctttttacgcaggacaggattttgcgtaattggggacgtttatggcggctatttgtccctttttacgcagatagataggtgctgacgagtggggttcgtttgcgtaatctgggacatgggtggcgggtgggtgtgctattcagcgaaggtgcggtcgagccagtccttggcgaggaagatccacgactgcacggcgggttcgatgctgttgacgccgccccacgcggtctgcgcggtgccgagcgagagtccgtggccacctgcggggtacagatgcgcctcaatcggcacgttggccgccttgcatgcggcgatgagctgcagcgtgttctccaccggcacgcaatcgtcgggcatcgtgtgccagacgaacaccggtggcgtcttcgcgtcgatatgctgctcgatgctcacttcattcatcgccgactcctcgccgtaccgctcgccgaggagcgcgcggaagctgccgtcgtgacggaaacgccccgatgtgatgaccgggtaggagagcatcagcgcgttcggccgcagttcgtccggatcatagccgtgcgcgacgagcgcggcatcgctggcggaagtggcgaaatccgcggccagatgaccgcccgcggagaagccgatgacggcgatgcgcgcggtgtccacgttccattcgtctgcgtgcgcgcgaatctgccgcatggcttcggccacctcgagcacggcaatggggtagacggacggtttgcaggaatagtggagcacaaacgcgttgtagtcggcggcgaggaactgcagcgcaatcggctcgccctcgcggcctgtggtcatctcataaccgccgccgggcagcacaagcacggtcggacgcttgcggtcgggcacgatgtcggggtagttttcgggaagatagcctgcaaaacgcgctccggaaccgtcgatgccgatgatggtggtctcaaaatactgcatgacacctctttcgttgagcgggaatgggcggggaagagcccgcgccttgtttgttcaacgaacatacaatagaggcgccggttgacggtgttgtggtttgtcgccggcgatatcgcccatggcaaacgacggaactcagatgccactttcgtcgtttgccggagcgctttgtttgtaactccggtctcacccaggcgttgaggaacctgcagagtagccaatctgagattgcgattgcaaactgggcgatcctgcatgctgccagtgtgccgatctgagactgaagtcgcaggctgcgcaatcttgtgctccgtcaacatgtctcgcgtgcaactccagtctcgcttgagcaatctaggaatctgcagattgctaatctgagactggagatgcgaactagacaattctgcatgctgccggtgtgccgatctgagaccgcaactgcagactaggcaattttgcgcaccgccggcatttgcgttggtagatgacgaaaagtgcgccgcattttgtcgtctgccatgggcggcgatgaatgtggggcgacgtgttagatccagctgggcagccacatatgcatgcgccagaactcatatggcacgggcatggccgtccagattgggtagaagaacacgctgacgatggcgcacacccccaccatgacccacagagtgatgagccacacctcgcgcgaactcgtctcgcgcacccagttgaacacgtagcagatggcgagaatcatccatggcagcagcacgatcgaatagaacgtgaacgtggtgcggttcaggtactgggcccacggcagccagccgccgaggaacccggcgagcaccgcccagatgcgccaatcgccgcgtttgagaatcgcgatgacaatggcgagcactgcgcacagcgaccccagccaccagatgagcggattgccgagcgaggtcaccgccgccacgcactgcgagcgcggcgagagcgagcacaggcccgggtggccgtccagcttctgccagtagaagctcgtcgggcgaatctgcagcggccaggtgagcgggttcgccttgtagtcgtgcggagcatcgagcgtggtgtggaagcgccacatctcggcatgatatgcgacgaacgagcgccagtcggccggcagccattgcacgccctggccggtatgggtggccgcccaattacgcatgtaggagttcgggtgcacgaaccagccgacccaggtgagcaagtatgtggcggcatacagcggcaccatgtagagcgccgcgagcaggccgtcgccgaacacgccgcgcgcaagccattgacgaggggagcggaagccggcctggcgaatcatccaggcgtcccagaacacgctgatcacgcagaacacggcgaagaaatagatcccagaccacttcactcccgtcgcgcagccgagcagtacagccgcacctgctcgccaccaggagaacgtgatctgcggaggtctgttcgcaccggactgcgccgccatgcgtagtctggccgccgcccagtcgcggtggatgagcagcagcgagaacgcaccgagcgcgaacaccatgatgaagatgtcaagcaggccggtgcggctcatcacaatggacacgccgtcgatggccatgaggaggccggcgagcagggcgaccggcagattgcggaacagccgcagtgtgatgcggatgagcagcacaatgccgagcacacctgcgatcgccgtcgccgcacgccatgccgccgggttcgccgcgccgccgaacagcttgagcccggctgcgataagccatttgccgagcggcgggtgcaccgcgtattccgcggtgttgatccatgcattcgtgtcgccgtctgcgaacgcggtgtcgaccggcaccatctggccgcccagactcacctcgtcgggccagctcatcggttcgcccgtgttgagcatggtccaggcgtccttcacgtagtatgtctcgtcgaagacgaccgcgcgcggctgcccgagcctcacgaagcgcagcagtccgccgaacaacgcgatgaccagcgtccacacccacgtcatgagacgcgcatgggcgctgggcggcgatgatgccgcgagttcggatgattcgagctcgacgcgctctgccgccgcatgtttgggggtgcctgtggaacgcatgcccatctgttctccttacatttcgcatgcgcgccggccgcgcgcacatacccggttccacggtacacgcccgcgtgggttcgcgccgacgtacgctcctgcatcgcctccatcgcaccgtgtttcgcctcccgctgacctgcccgcgcggcatactgaacgtatgaacgagcagtctgaacacaccggcatcgccgaggatcccgctgacgagacgcgcactctccacgtagatgttccacgtggaaccgtggtgctcgccgccacaccgatcggcaacactgccgatgcctccgcccgactcgttgcgctgctcgagcgcgcggacatcgtggccgcggaggatacccgcagattgtatgcgctcgccaaccggctcagcgtgcatgtgggcggccgcgtggtggccaaccacgaccacaatgaacgcggcaaggccgacgcactgctcgaccatgtggcgaatggcgagaccgtgctcgtcgtctccgacgctggcatgcccacgatcaacgatccggggctcgccattgtgcgccgcgccatcgaacgcggcctgccggtgacctgcgctccgggcccctccgcggtgctcgatgcgctcgccctctccgggctgcccaccgaccgtttctgctacgagggattcctgccgcgcaagcattccgaacgcatgcaggcattgcgcgcgttgaagggcgagcgccgcacgatcgtgttctacgagacgctgcaccgcattgccgaatcgatggcagatctcgaggaggttttcggcccggaccgccgcatggcgttgtgccgagagttgacgaaggactacgagcagattcgccgcggcaccatccatgagatcaacgagtcggttgccaacgatccgccgcgcggcgagatggtgctcgtgatcgcgggcgcttctgaagacgaggcggatcccgcacagtcgctctccgtggaggagctcgccgaactggccatgcagtatgcgcaggcgcacggcatgcgcatcaaggacgccattgccgaggtgataggcaaacacccgaatgccgatggcacactcgccaaccgcaagcaggtatacaacgccgtgctggcgttgcgcgactgattcgccgaccggcatcccgttggcattgccgggcctatgacgttcgcatgcgctgcatggaactgcgttgcaattcaagcgattcgagtaccaattccaacgcctgcctgactcccggccctccctgctgcgagatgtattcgagcagattcgcgtccgccgcgcggttcaccaccacccatttgcgcaacggcggcatcgtgcgagcgatgtgccataacgcgtccatcggagtgttcggatcgcttgccgactgcggtgtgagcgcgaggggcggcggtggcggatgcagtaggcccttgttcggcgtgtgtgccgtgtgcagtgtgctcgccaaccgttttgcactgctgcgtcgacgcggcgcttgcgatgccgtgcgcgatgcggcatgtctgcgccgtgccgctcgcagcggcatgccggcacggcgagccggcatgcatggcctgtgtgcacgggcgtgggggagtgcgtccataatctctttttccttctttcattgctttcctcggtcaggcgatgctttcgaattgcgtcagcatctcgcgggcctgcggcagattgcgcagatgcgagcattcctcgagaatcggctcacagtcgaccaacgagaactcgtaatgctccatgagccgtccaatgatcgactgcacgtcgcgcgcatgcgggtcgtccttcgggtacatggccagatcgcaggccgttcgcaatggtgtcgtgaggttcagagtgttgagggtggagatctgcgattcatccacctgccgctgccatgccttgatgcgccgtccaaaggcgagtctgcggtaatggctcgatgagagcacttcgaaataatcctggggcagcctgccgcccacccatacccacgcggctgtgcgcccgcatgccgtggtgcgattgggcagtatgtcgcgcatcagcatggcgcgcccgtacaacgtgtgcgcgcattcggcggtgactgcgtggaactcgtcgagctcatacaacgcgtcgagtctgagcagtcgttgcatggcaagggggccgggcagctgtttggtgtggatgatcgaatgtgagttgtgggggcgttccggctggcgcgggacgcgcggttccggatccgcataggcgggacccaggtcgagcgggaccatgtagccgacctcgttgccggctcggaccgcttcctgtacggcggtggtgttcacggacgtatgttcctttctcttctctctcccttgcctgtaggtcgctgcgtatgcgcacggatgcgcataccgcacatgctaggaaggacatggggtgggctccagctgtttcgggggaaatgtggatatgtggataatgtgaaggcatgcgatgtggattgtgaataatcgaggctccgccagtccgcgcatggtgatgccgcaacagggcggaaaacagtgcggaagtgtcctagcgcatgaagataatcgggcgtatgagtcatattatggtgaacgtcgcttggccgtatgcgaacggcccccgtcatattggtcacgtcgccggcttcggtgtgccgtccgacgtctacgcaagataccagcgcatgaagggcaacgatgtgctcatggtgtccggcaccgacgagcatggtacgcctattctggtggaggccgacaaggagggcgtcaccccgcaggaacttgcgaaccgctacaaccgcgtgatcgcgaacgatctgtgcaacctcggcctgagctacgatctgttcacccgcaccaccacaaagaaccatgagcacgtggtgcaggagatgttccgccagtgtctggccaacggctacatttacaagggcacgcagaaggtcgcgatctcgccgtccaccggccgtacgctgccagaccgctacatcgaaggcgagtgcccgatctgccatgcgcagggcgcgcgcggcgaccagtgcgacaactgcggcaatgagctcgatccggacgagctgatcaacccagtttcgaagatcaacggcgaaacgcccatcttcgaggagactgagcattacttcctcgacctccccgccctggcggaggcgaacctcgcatggctgaagacgcgcaagggctggcgcccgaacgtgctcaacttctcgatcggcctgttcaaggaggtcaagccgcgcgccatcacccgcgacatcgactggggcatccccgtgccggtgccgggttggatcgacaacccgaacaaacgcctgtacgtgtggttcgatgcggtgatcggctacctgtccgcatcgattgaatgggcgcgtcgttccggtgatccggaggcttggcgcgcatggtggaacgacccggccacgccgggctactatttcatgggcaaagacaacatcacgttccattcgcagatctggccgtccgagatgctcgcctacaacggcgaggggtccaagggcggcgagccgggtgagctcggcaggctcgacctgcccgagcaggtggtggcctccgagttcatgaccatggagggcaagaagttctcgtcgtcgcgcggcattgtgatctatgtcaaagacattctctcccgttacccggtggatgcggtgcgctactacatctcggccgcaggtccggagtcgtcggactccgacttcacgtgggccgagttcgtgcgccagaacaacgaggtgctcgccgcctcgtggggcaatctggtgaaccgtgtggcgaatctgatcgccaagaacttcggccagatcccgccgatcgtggaggaaaagatgaccgatgaggaccgtgccctgctggcgcagtcctccgcagccttcgacacggtgggcgcgctcatcgagcagcatcgacagaagagcgcgctcaacgacgcgatgtcgttggtgggcgacatcaacaaatacatctcggccaccgagccgtggaagatcaaggacgacccggagcgcctcggcaccgtgctgcatgtggcggcccaagccgtctccgatgccaaccacctgctcgccccgttcctgccgcattcctcgcagaaggtgtgggaggccctgggtggcgagggtacattctcgccgctgccgcacatcgaggaggtgaacgatctcgacgatccggagttcacctacccggtgatcaccggcaagtatgtgcttggcgagaacgtgcatccgtggaagagcgagccgatcgtcgtgggtgcgccagtggtcaagccgacgccgatcttcgcgaagatcccgccggaggccgtggacgaggagctcgcccggttcgacgccgacctcaaggcacgtcgcgaggccgaacaggcgcgcctggacgccgagaaggccaagctcgctgccggcgaggagtgactcgtctgattcgcatacaatctgcgtaatgcagtccgtgtaagaagggacaaatagacacgtctatttgtcccttcttacacggggaaacatgcgatgactggagcacgtgcgagtccttcctgtgtgaaattggttttcctcgcgtaaaaagggacaggtggcagtgtgtatttgtcccaatttacgcagaagaacatgtggaggaacatatgcaggaagaaggtggctgaaatatcgactgaaatatcatcgtgcgagccctccttgcgtaaaaagggacatctgtatcttctatttgtccctttttacgcaaagtggattgcgggatgaggctgttgatctatcagtcgcgggcatccgacagtcatagagttcgctggcagataagtcggcatgagggcagattgtttgccagcaattgccgcactgctgcggcggctgaggttccaatggctggaatccatgtatttgcaaggcctgcggcagatgggcggcactgctccgcgcgctctacacctgccctgcagtgtgccgataggagcatacccagcgaattctcagcgaaaacactcgatgcgttaagggtcgacgggcatggtaataaccatcggcaatcgaaagaaagccgacgaggttccactcggaatcccttataactgaacccttttctctcttctctctgttagccggcggtttcaatcccgccggcttctctctttctgcagggttttcggactccattcgcatccaggcagcctctccatcgcataacacgccgaagcggcagccggttgcatatcgcggtgaacgcgccaataataaggcgggcaaacaaagaaatacccgtatgccattcgcgcacatatacgccacaggcatggcatcgatgcatacgggcaatggacgccggcatatcggcgccgcccagacatgcatacgcacagacgcatagcaaggacgccctcgatgtacgttgacccgaaccgcaacaggaacgccagcaatctgtgctggctcatgccgtattgcaggccggagctgccccgtgtgatcggcgcgcagatcctgtacctcgtcagcgccgcgatggcattggtcacgccgctcatcgccgcgcgcattgtggaccgcgtgatcgagcagcgccagctcagtctgctcaccggcctgtgcctggcgctgatcggcgtgacgatcgtgcgcgacggcgcctactacggcaaccagatgtggatggaacgcgccgggcagaacaccgtgtaccggttggtgagcgacgaatacgagaagctgcacacgctcgacttcgattatttcaatcacacgcgcaccggcgacatcatgagccgcatgacctccgacaccgatgcgatccgccatctgctcagctgggtgagctaccagatgctcaactgcgtcgtcatgttcgtgggcgcgctcgcgttcatgacgtcgatcgactggcgtctcgcgctcgcgctcgcctgcgtgacgccgttcctgttcattttcacccaccagttctccacgaaggccaagccgctgttccttgcgatccgcaattcgctcgcctcgatgaactcgatggtggaggagaacatcgaaggcaaccgcgtggtcaaggcgttcgtgcgcgaggactacgagaccgggaagttcgacgagcacaacgacgactatatggatcgcaacatggccatggcgatgaacacgcgcaagtatctgccccgccttgactggctcggtttcgcgctccagctcatcacgctcggcttcggtggattccttgtggcgcgcggtgcgatgagcctgggcggactcgtcgcgttctcgtcgtatttgtggatgatcgacggcccggtgcgccagttcggctggctcgtcaacgactggcagcgcttcaacgcgagctgtgtgaacattcgcagactcctcaccgccacgccgcatgtgaagaacacgaaggccgcgcgtgagggcaccgttcccgattcgatgcgcggcgacatccgtttcgaccatgtggatttcgcgttccccgacgacccggacacgttgattctgcacgacatcgacttccatgcacccgccggctcgcgtctcggcattctcggcgagaccggcgcaggcaaatcgacgctcgtgaacctgatcgcacgcttctacgacccgacctcgggcaccgtgaccatagatggcatcgacgcgagacgctggccgctcaagcagctgcgttcccaggtggctattgtggcgcaggacgtgttcctgttctccgacacaatcgaaggcaacatcggcttcggcgcgagcgacgaacaggcgaccgactccgatttcgtacggcgtatggcgcagatcgccggtgccgacgacttcattcgccgcatgccggaaggctaccagacggtggttggcgaacgcggcgtgggcctttcgggcggccagaagcagcgcctgagcttggcccgtgcgcttgccgacgatccggcgatcctgatcatggatgacacgacgagtgcggtggatatggagacggaggcgcagatccagcagcatctcaaggacctcgacgaccgcaagacgattgtgacgatcgcccaccgcatctcgtcggtcaaggactgcgatctgatcctcgtgctcgaccacggtcgcatcgccgaacgcggcacccacgacgaactcatcgcccggcacgggctctacgagcacatctacgagaaacaactcggccaacaggccgacaatctgcggcaatgatcctgccggtgggtggaccgcggatcggcggatccggcggggcggggctggcctcgcttcgtcggttgtctgcgttccgtggcgctcctcagcaaggcccaccccgccccgccggatccgccgatccgccgtcagcaatcaacaattcgcaatctgtaatccgcacaccaatctgtaatcctgaaaggaggcgagccggtatggcacagcgcaacacgtaccgcgaagacgaagagctcgaggagagcatcaatttccatgatctgcgcagaataggcagatacctgcgccctcatggcaggcggctcgcgagaatagcggccgtcgtgatctcgatgagctgcatcacggtggccgtgccgtacctgaccaaagtggtcatcgacgacgtgctgccgcacaggaactacacgctgctggcatggctcgtcgtggtcatgctcgtgctgagcgtgctctacgaggtcgcgctgcgctaccgcacgctcgagatcacccgcgtgggccagctgatcttgaaggacatgcgccgcgatttgttcacgcatatccagacgctgccgttcagctacttcgattcacgcccgcacggcaagattctgatccgcgtggtcaactatgtgaacacgctgtccgacacattgagctccggcctgatcaacgtgattgccgacgtgttcaccttcgtgatcacgctggtcgtcatgttcgcgattgatttcaagctcgcgctgtggagtctgctgctgttcccgctactcatcgtggtggtgcgcgtgctgcagcatttccagcgcaaggcataccagaatctgtcgaacaagcagagcaacgtgaacgcgttcattcacgagtcgatcgccggtgtgaagaccacgcagaccttcgcccgcgaacacgggcagtacgagacgttccagcatctgcaaagcgagcagcgaagcgcgtggatgcgcgccgtgcacatccagttcctgctgtggccgagcatggagatcatctcgatgtccacgatggcgctgatctattacgtcggcatcatgcacgtggccggcgtcaccgcgaccaccggcacattgatcgcgttcgtcggctatgcgaacaacttctggaacccggtgatcaacatcggcaacttctacaaccagctcatcacctgctccgcgtatctcgaacgcatcttcgaaacgctcgacgtgcagcccgacatcgtcgacaagacgaacgccgaaccgttgccgccgatccgcggcgacgtgcgcttcgacgacgtcgtgttccgctacgaacccgacggcaggaacattctcgaccatgtggacctgcatgcgaagcccggccagaccgtcgcgctcgtcggcccgaccggtgccggcaagacgacgatcgtgaatctgctctccagattctacgacgtggcgggcggcgccgtgctgatcgacgaccacgacgtacgcgatgtcacactgcggtcgctgcgctcgcagatgggcgtcatgctgcaggacacgttcattttctcgggcacgattcgcgagaacatacgctacggcaagctcgatgcgaccgacgagcagattatcgcggcagccaaggccgtgcacgcgcacgagttcattgaggaactgcccgacggctacgacacggtggtgcaggagcgtggctccacgctgtcgatgggccagcgccagctcatcgcgttcgcgcgcgtgctgctcgccgacccgcgcatcctcattctcgacgaggcgacgagcaacatcgacacccgcaccgaggaggcgctgcaggctgcgttgcagcacatgctcgtcggacgcacgagcttcatcatcgcgcaccgattgagcacgatcgagaacgccgacatgatctgcgtcgtcgaccacggccggatcgtcgaacgcggcacgcacgaggagctcatggccaagcgcggcgaatattggcgtctcgtggaatcgcagtatgcgatgatctcgggaggcgactgaaacaccctccttggcgcgtttgctgtgagaggaatagacgcggcggccgacgggcaatcgtgccgaatggcatgctgaaattaggtaatcaacgcggaaacgcacatgatgcgcgttccgggtcgaatatggagcgcaccgcatacagcggtcttggaatgccgaccgcatgtgccgcgctggtattaggaggaatcatgcaagacaaagacgatatgctgccgaagaacgtgcagcaggacatcagcgaactcaccaagcccgacgtcaccgagcacgaaagcgcatgggcgacctacagaaaactgccgaagagccataagtggccgtacttctaccatcatttcttctggcccatcatcgtggccgtcgtggtgttcgccgcgatcgtcgcgttcgtggtgaacatggtcatctcgccgaaggggcagggcctcggcgtcgccttcgtgggcgtggaggaatccgaccgctcgatggacaagctcgaagacggcttcctcaaataccgcgcgctcgacgagaagaagatcacgttcgagaacgatctctacatcgactcgtcgaacaaggaatctgcaagcatgtcgctcgacacgctcgaaacgcagatgtcgggcggcacgatcaacacgatcatcggcgacgactcggcattgcgctcgcagcatctgctcggttatctcgagccgcttgacaacgtgctcacgtcttaccagatgggcaagctgcgcgagcgcggcgcactcgtgacggacggcgaaggcggcgcggcgaaggcgatcgatctgggcaagtcggcggaatggacgcgcatcaaggggcaggacccgcatgcccagctctcgttcgtgaacgtgcagaacaaggattacgcaagactgttcgtggactacctgttcggcatgtgaccgacgtatgcgtgcacatgttcgcaatatcggcgaactagcgtagtcagacggcaacgcagaggaaggaatacgtgatgcttgaacatagccgccccgcattgttggacgagttgacggcgccccgcaacgccttgaagccggattcgaaagggcgcatcgtatggggcaacggaacggtgacgctcgtcttcgccgtgagcgacgacagaccggtgacattgatcggcatgagcggccggggcatggagccggtagatgcgaacatcgccggcgaaccggatgcgcagccgatcgtggaactgcgcagttcgcttgacggcggcggggacaacagactgaagctcgccgtttcgtccgccggcctcaaactgaggttcgtgcgggcatatgagctcaacagattgggcgatgagcgacagccggtcacgctgctcgcgattgtgcagcgcgacccggacggggacggcccgttggtgacgagcgtgttcgaggccacggcgcacacgagcgccgtgcgcacctacacacggttgtgcagcgaggagccatatccagtggaggcggtgtcgtcgatgaacgcaacactgcccatggaagcggccaaactggaggatgcgcaggcgcaggtctattggggagaaagctcgtgggactgcgagaacgcctggcaaagcgccccgctgcgttccaccacgctgcgcgaccgcaaccaggtgatcaatccgggcatgtcctccgcccgattcgcccgccgttccacctcgacgtggtccaccggcgaattcgagccgatgggcatcgtcgaaggaggcggccgcccgggtgagctcggccatttctcattcgcatggcagatcgagcacaacggcgcctgggaatgggagatcggcgaggacgacccgggtctgcgcgtgagcgcatacgggccggaatacgacgaccatcagtggttcatcatgctgcgcgacaaccagcccttcgtcacggtgccggtctcgttcgtggtctgcgcgggcgactggcagcatgccgtggccgagatgaccgtgcagcggcgcgcgctctaccgggcgaaggccatggagatggggcgtctggagcaggccgaacaggcgaagggtctcgtggtctacaacgactacatgaacacgttgtggggagacccccgcatcgagaaggagctgccgcttgtggagggcgcggccaaggtgggcgccgacgtgttctgcatcgacgccgggtggtacgacagcgaggacggcggctggtgggacatggtgggtgaatggaaaccctccatgaaccgcttcggcgacatccgcctggccggcctcatccacgacatccagtcacacggcatgaaggccggcctgtggctggagccggaggtgatcggcgtgcgctcgccgctggcgaagatgctgcccgactcggcgttcttctgccggcatggcgtccgcatcgccgatcagggccgctaccatctcgacttccgctcgccggtggcgcgcgcccatgccacggccacggtggaccgcctgatcgacgagttcaatgtgaggttcttcaagttcgactacaacacgacgccgggtgccggcaccgatgtcgacacggattcggtgggcgagggcctgctcgagcattgccgcgcggtgcagcagtggatcgagcagatccgcgccaaacaccccgacgtgatgatcgaaaactgcggttccggtgccatgagggccgactatgcgatgctgagccgcctcgacatgcagtccacctccgaccagtccgatccactcgtctatgcggcgatcgccgccggcgccggcatgacggtgcttccggagcagcagggcaactggggctatgcacagcaggagatggacgacgagaccgccgtgttcacgctggctgcaggcattctgggccgcctgtacctctcggggttcatcgaccgcatggacgaggcgcggctgggcctggtgcgcgatgcgatcgcactgcaccgcacgatcctgggcgggcaatcgcatctggtgccatggtggccctgtgggttgccggacttcaacagcccttggctcgtgtatggtttgcggcatgcccccaatgtgaccgggctgtcgcatgacgaagactggaatggcactgacggccaaggctccgagcacgtcgatgaggcccaatacctgaccatctggcgtcgtggcggcattaattcgctgtatttggagattggtgagggagcccatatcgagcaggtgttccccaatccggccaagccggagcatgcgcccgatgccaagccgtggcgcattgaatgggcggattccgagaccgtgcgcatcgaagcctccgcagacaaggagccctccgcacgtgtcttcgccatcacattcccgcagccatctgccgatggcacagcggatgacgatgccagcgagaacgccgggcacgatatcgaggggcgataatctgcgtaattgagaagtttatatgaatctgcaaataaacttctcaattacggggcgctaaatcagaagtttatatgaatctcaaaatatacgccccaaatagcgcgggtcaccgcgaacctgccggcagatttctcaaaggcaaaggtggcgggcggtagagtgggagcatgagcaagaagcacagggttcgtgattgggcgccactgccgcccgcattgccgcaggacgcccacgtgatcgataatcacacgcacgtggcctccgtggtgcctttttcacaggcattgagtcatgaggccgtcgagaaagggcagccggagatcgccgtctacagcgtcgaccaactgctcgaccaggcggccgcagtgggcgtggagggcgtgatcgactgcggttgcgaactgccccacctgatgaccgccatcgacatggcacgcgaacacccgggcagcgtgtgggcggcgattgcgatccacccgaacgaggcggtgttgcacgggcatcgcggggcacccggccccgacggtctgccagtgcgctacaaaccatggcacgacgtgccgttcgacgaggcgatgaccgaagtgcgccggcttgccaaggcatatccgaaacaggtggtggcgataggcgaaaccggcatggacttgttccgcaccggcgagagcgccaaggagattcagcgtgaggccttccgcgaccatatcgcagtcgccaaggagctcgaccttcccatgcagatccacgaccgcgacgcacaccgcgatgtcatcgagacactgctcgcagacggcgccccgcgcaaaaccgtgttccacagttattccggcgatgccgagatgggcgagatcgcacgcgagcacggctggtatctttcgctgtcgggagcgtcgagctacaagggcaacaccggcattcttgaatctgcggcacttgtggggctcgaccatgtgatggtggagaccgacgctccatacctgacgccaatgccgtaccgcgggcggccgaacgcgccgatgatgatcccgtacacgctcgccgcgcttgccgaatatctcgacacgccggtcgaacaggtcgcacgggccacgcgcaacaccacgcgcgaggtgtatggaatctgagccggaagcgcccgattggggccggttcgcaacggttatggtcccgcaggcatgccccgtgcgcagggaatgcattccccgttgaccactctgccttcggcggattggccgagggtgttgtctcgatgctgattagtgtggcagtttgcgttgtttcttcacagtgtggagtgccccaaggcgcgccatggtataaggaatgagtatggacgaaagaccggagcagcaagcggacgagccgctgttacgcaccgccgacaaatatacgcaggcaccgaaggtgtcgcataaggtgctcacgaaggaagagcgcctggcgatcatcgaggcgaacgaaaagaaacgccaggaggccgccaagctcgagcagcacaaggcgttcggtccggtgggtcgctggtggcggacgctgcagtccggccccgacaaggtgacactggccatgtcgatcgtggcgctgggcgtggtgtacggagacatcggcacctcgccgctgtacacgatgcagacgttcctcgccggtcagggcggtgtgcagcatgccgacgagaccgcggtcataggcatgctctctctggtgttctggacgatgacgctcatcacgaccgtcgaatacgtgctcatctgcatgcgcgtggacaacaagggcgaaggcggcatcttcgcgttgtactcgttgctgcgcaaatacggcaaatggctcatcgttcccgcgatgatcggcggggccgcattcctcgcggattcggtgctcacaccggcgatgtcgatcagctcggccgtcgaaggcctgcagacgctgcccgcattgcagggcgtgttcgaggagaacccgagcctgacgctgttcatcgcgctggtgatcattctcgccgtgttcgccgtgcagtcgcgcggcaccgagcgcatcggcaaggtgttcggttccaccgtgctcgtctggttcctgttcatcgcggtcaccggcgcgatcagcatgtcgcagaacctcgaggtgctgcgcgcgctgaacccggtgcatggcatccaattcctcgtcagcggcgacaaccacgccggcctggcgctcatgggcaccgtgttcctgtcgatcaccggcgcggaggcgctgtattccgacatgggccatgtgggccgcggcaacatctacgccacctggccgttcatcaaccttgcgctcgtgctctcatacttcggccagggcgcgtggatcatccgcacgctcgagaatccggcgttcgtacccgacgggaacgcccccaacccgttcttcgccatgctgacgcccggcgtgcgctacgtggccgtgctgctgtcggtgatcgccggcatcatcgcctcgcaggcgctcatctccggcgcattcacaatagtctccgaagccacccgcctcaactggatgccccacctgcaggtgcgctatccggcccgtacgcgcggccagctgtacattcccaccgtgaacgtggtgctgtgctgctccacgctgctggtgctgctcatcttccgcaattccgagcacatcgccgccgcctatggcttggcgctcacgatcacgatgatcatgacgtcgattctcgtcaccgtgtacctgtggcatatgcgcagcagattcgcggcggtgctgttcgcgatcgtgttccccatgatcatgttcatgttcttcatcgcgtcgatggccaagttcctgcacggcggctggttcacgatgctgctcgcgctcgcgatcctcaccgtcatggccacgtgggacgagggcacgaagctcgagcgcgcgcaacgtcgccacatgagcccagaggattgcctgccggtgctgcatcgcctgcacgacgacgacacgattccgtactatgccgacaacatcgtgtatttgacctccgacaccgagatgaagcgcatcgacaccgacatcttcttctcgatcttcgcgagccacccgaagcgcgcgcacgcttggtggtgcgtttcggtggagacctcggacgagccgttcacgcgcgaatactcggtggagacgctcggcacggacttcctgttccgcgtgcgcattcggctgggattcaaggtgcgcacgtcggtgccggcgtatctgcaccagattatgcacgatctgctgcgcaccggcgaacttcccgcgcagaagagcacgtacccgaaggtggatgccgatccggagatcggcccgattcgctacgtgctcattcacaaggagctcatgcccgagtcgaaggtgtcgcaaaggggtgcgatggccctgcgcatcaagtatgcgatccgccatgtcgccggctcgcccatcaaatggttcggcttggccccgtatgacccggtgaccgaggtgcagccgctgttccttgccaccgtgcgcccgccgcgcctgaagcgcatcaactaggctgtgcgcacctgtgtgcagtgaccctttgcgcgtaggtccgtttgcgtaatttgggacaggttcgcgcggttttctgtctcttttcacgtaaagcgagctttcgcgtaaaaagagctttttatgcaaatcgggagggacgttttgctcggggtaaatcttgcggtgcgggatttcggcaggccgtgtgcggggacaatctgtgaaaatcgttgaaatcccgacgatgagatgcccgttatagaaatatgcgataacgggattgcgagaaaatgggtgaatgggcaacatgcgcacgctacactcgacaaccatgtgcagattactgggatacgcgaccgcgaacgagaacatctcgctgcgcgaggtgctgggtgcgcagagcaccgacgccttccgcgagctgagcgagatccacaacgacggttggggaacggccatggtgaaggagccggaccagactgcccatgtgaccgatggcggcgcgccctcgccatccaccggctcggcgatctaccgcaatacaatcgccgcgcgctacgactcgattttcggcgacttggcaagcgtgccggtgcgcggcggaatctggcatctgcgactggccagctcgaatctgccgctcgtgctggagaaccagcagccgttctacgcgagcggactgagcttcattcacaatggagacatcagtgatgcgcaggggcgcaacatcacgacgaaccgcgcatacccggtggaccacacgctcgtgcagtccacgggtggacgttcggattccgcgatctacttcgccattgtgctgcagtacctcggttatggctacgaactcgaggaggcgctcgctcaggcggtgcgcgaactgcggggcgcatacccggattccagctacaactgcataatccagagccgcgaccagctcatcgtgctcgaggcgcacgacaacgggcccacacagcaggatgtgctcgacgtgtacgcgcagtacgggcgtgccgcagaggccgcagattaccgcacggtgaggtaccgtgagatcaccggtgcggatggcgcgcgcaagggcgtcgtcgccgcgagcagcggtttcgcgcagccggcggacgaaggctggaaagacctcggcaacaatcgcatgatcgtcgcctcgaaccgcacgggcgccttccgcgtgcgttcgatctgaatcgttggtgggtgagcgctaggataccggcggcaatctgccgcgcgcctgctctcgctctgcgttcgactggctctcggcctgcgtaatttgggacatttacctgcgcaaatctgtctctttttacgtctcgacgacgtaattggagacatttagcggcaccaatctgtccctttttacgcaggcgcgcatgtgcgcaaactatgccaatttgcggcatcggggctagagtgtgggtatgagcggaatcattcctacattcggccagattgacgaactgcatcgcaaatgcgcgcaatcgcaggccgcctacgatctcatccatacgcattgccagatcatcgcgcagattacgcggcagctgattcaccggcagaacgcgctgttcatgcgccgctgcacgctgccggacgacgcgctcgagcgcacgggagactaccccacgctcgccggcgaacgcattgccgacgccatcggctcgccggaggaagatcggttcgtcgtgccacccaccgacggcgtgaccggcggcatggtgcccccacggtacatcgacgtggaaaaggccacgatcggcgccttgctgcacgacataggcacctacgccgtgctcaagaacgacggttcgaacggcgaaccgctgagtttcgatggcccgcggtatgtggagcatggtctcatcggctatgaactgctcctcaacgaggggtatgacgaatcgatcgccgaattcgcgcgcaatcacaccggctgcggactcacgagggaagatgtgatcgaccagcatctgccgctgccgccggccgactacgtgccggtgaatctcgagcaggaggtggtcatggtggccgacaaataccacagcaagtcggtgccgccgaagttcctcaccgcctccgcctacgcgcgcaaggcagcgcggtttggcgcggagaacaagcagcgttggcttgaactggtgcgcaaatacggcgaaccggacgtgccggcgctcgccgagcattatcacatgcgtttggtcgactgatccgcagattgtagattgcagattgcttacgggctaggattttccgttacgggctagggcaaactaccacggatgcacggtagcgtgaatctcaaatcgccatttttcaacagttggggatttctgtaatgcatgttgccccagcccgtaacgagaaatcctagcccttaacgggaaacgtggcctgtaaggtcagcgcaggtcgatgatgttgtcgaactgcttggcgatctgctcgctggcggtgacgacgatcaccgtgcgctgcttgtccggcgtgctcacctgtgccttgagcaggttgagaacctgcttggtgtcggtctcgttgagattgacggtgaggttgtctgcgatgatgtagtccgggtcgatggccaaggcacgcgcgatgctgagtctggccgcatccaccgggtcgagttcgtcggcgagggtgctttcgtccgccttcgtgttctcgccgaaccgcgtgcgcacgaggaggtcttgcgcaagccccttcactggtttcatgaacgtctgcccggaggcgttcatgacgtaggtgaggttttccacggcgttcagatcgccgcgcagcgagaattgcggcgtgatcatgccgagacgatgaccgcgcagctgctcggcgtccatgtcttcgtacggggtggtcttcgtcatgatctcaccgcttgatggggcgatgaagccgccgatgagcgccagcagcgtggcatggcggcgcgtgtcatgcgcgtccaccatgatcgcgtagcattcgccggcctcgcaacggaaggtgagatgctgccagatgtgctccttcgtcttcgggtcgctcaccgtcacatcgtgcagcgaaagcatggggtaggcgcggaagatcgaggatccggcgagcgcggcgtcttcgccatcttcctcggcctgcagtgacgagtcgagatggtctgccacctgcaccacatccggcacggtgacttgcgcgttctcgttggagtgtgccggagccgtctctcgtgatttgtctgcggcaggctctccgtcggcatcggtatcgccatcggtcggatcggttgcgttcgcatccacggtcgcgctcagcgcctcgatgacggcgtcggaggagtcgttgcttgcagatccctcgtcgtcccagtaatcgaccacatagtcgaaggtgtcgggtgcggcgttctcggaggcgttttcctgcggggtggttggggtgtctttggaatctgtgtctttggaatcgtggtgttcggtcatgtcagtcctcggaatctgcggaatcggagatgtacggcgactcgaagagtcgaatggtgcggaagaaggtcacgcgcaggccggcgacaatggccagcgccaccgagcacagcacgccgatccagatcacctgccatacgaggccaccggttgcatgaacgtcatgctgagcccccaatgcgcctgccagcgggttggcggtgcatgcgcccagcaccaagcccacggcgaggccgacgagcgtcggcatgaacgtctcaagcatgaactgccatgcgagacgtcccttgctgagtccgacgagcatgcccatgccgatctcgttagagcgggggagtgcggcgagcagcaccaggccgagcagtgcaagcgcgccgcagatccacagcacgatcatgatgatgcgagtggttccggcaagcgtgcccagcgcttcgatcgactgcatgtagtgggtgatcgtgggcgagctcaccgtgaagcccttcggcaggtcggctttgagcgccgcggcgaatttgtcgatgtcgctgcggttctggaacgtgaacacgacgttgaggtccgggattgaccagcctttgcctttggtggtgtcgaatccgttcacggcgaaggtggtgtacgtggtgtagagcacgttgttgcggttgtctttggcgaatttggcgtcgtcgccttgcgcgttgtcggggttgccggtgtagcggtagatgcccaccaccgtgtattcataggttttcttcgcatcggtggggttgccgatggtgatggtggagcccactttgaggttgttcttcttcgcgagcgcttccgagatgagcacgttctgcgccagggagttctggtagtcgagccctttgccctccaccacctcgtatgggccgtattcgttcgcctgtgcggcttcggccgtgtagaagctctgcagtgtgagattgccgccggtcttgtcggcactggcatcggacgtcttgcctgtggtgattgcctgcaccgacttgctttcgcgcacggggacgctttcggccaccgtgtatttgtattgcatgccttgcgtttgcccggcggaggcgagcttgtcgtagtccgaccaagacagatagtgttcggtccaggaggagtcgtcgccttggcgtgtttccaacagctggctggacgggcggatcacggcggtgttgctttgcttgtcgagtgtttccgtgcgcgccttgtggttctcctgcagcactgcgcctccgaatgtggaccacatggcgatggccgcgctcaccagtacgatgagcaggctcctcaatggatggcggcacagcattttccaagcttggccgaagatgaacatagtaccccgcaatctgtattcatgcaccttgtgcgttcctgagtaagtatatttccaagcccggctatgagaatgctgtgaggcgaaattcgcggctgggttatccacaacagatgcacagttcatggtggattgtgatggcaggtcgtccacaatgtgcataccgcgacgttcattgtccacatattcacggtggaaattcaagttatccccgtggatatccactctgtcatccacttgtccacagatttttgtggatacgagaaattctctgtgcacctatgcgagtgtatgaatacgagcgctcaccgtgggcgccgcatctttaggaaaagaggattgcatgccagaaccattcgcgttcgattcgatcggcttcctgcaactgctcaatcagctggaacgcagattcgatgaggtggtctcccacgctcccctgagtttcgaccgcatcgattcacccaccatacaaccacatacctcgacggagtcttcgaacaggcgcacgggggcgttccataggcgcggctcggctgccaaggggcgtaatgcaacgccggaacgtgccgagaatgagcagatgtgccagacggtgtcggcgcaggtgcaggcgcagatggacctgttcagtcgcgtggatcgtcgcatcgacgtgctggcgcaggatctgttcggccccacgcattgggggtcgctcatacgcatggcatcgctcggattggatcacgacctcatcgacgaggcccgcaaattcatgctgtactgttcgtccaccgtgcgcaggcatggcatggcggtgtggttgtacgacatcatgaacgatgcctcgatggctctgctgctgcataagcccgccgaacacatgccggtgatcgtgaacgggccggatgtggtcaatggcagattgcggtgcggtttggatgccacagtgcagaggaccgggccaacgtggcaacgcgaatgctacaaccgcgtccattccctccacacctacatgttggcagcgtattgcgtggcgaaatggggcgaaccgggggagaggcggcgcgaactggcgacgttgatactcaacgactgggggttgggcatgtgcatgctacgtgaagacaaaacagtgcggcggctgggtgcgagcaccgacatgcggttccggcgcatcatccggtatcgacgcaaattgcgtgtgcaggccgacctggagtatgcgcatgcgttgatcgacgagcacgacgcctcggatgtcgaggagcatgcggctgccacgaaagccatggatcgcaggtacctgtatgacgccggaaaagtggtggaggcgtaccgtgcgttgtggaacaagcagacccgcagcacgcgcatgctgagcggaatgctcgaggagacgaatgcggtgccttcggtgccattatgggagaatccgctgtatttggaggatctcacggtgtcgctgatgggtgcggcaatgggttcgaagatcacgatgggctttgaacggcgcaatcgcgaggaattcgaggagggtgtgcgcctgctcgggcatctgtgcgacgatgtgcgcgacctcacggtggccctgctgcccatgcaggtggtggtgcggttcgagcatgagattgaggacggcgggaatttcgggctgtgcgatgccgatgaccccgatttctggaatctgtcgcaattccaggagaatgtgttctccgacatggcttcggtggtgctgcaacgcgtgttcgtggacgatgacgacctgaattccgaactggccatggccgtgctcaacgaccatccgggcacctatgcgcggttgatcatgccgtatttcgaagatgaagacgacggcgatgtcgattccgcggagcttgccgagatcgtcgccagtgcgaaggaaccggaaaccgccccacacagtgaatcggaacatgcactgggcgaggcggccggtgacgcggaaatcattgacgtggatgtcgtggcctaatgagccgtgccacggcacccattgcggcttgcgggcgtgctgacgagcatcattcgcaagcgatgccatcgccgtcgcggtcgagcttcggcgcatagccgggctggccgcggtggagcggtgccttgccggcctgcggcccgtgcatgcagttccgactgctcaatggcagggggccggccatccggccgttctcgcatgctatgtgaaatttctcattcgcgttgcctacactgtacgggtaccctgagaaacgcaaaccgaacacagaacatggtggaggagtttccatgcgcgagccggtcagtcaggcacaaccacacgggagcgtgacggcgtctgcgacgcacagtggcgggaaccgtcgcagtctgtgggtcagcatggccatcgcattcgttgccgtgatgatcctcgaggtgggcttctttaatctcggtcactggagaaccagtcgtctgcaggctgccaccgtgggcgatgccatcattggcgaaggtctcaaatcgttggggcatcacgaatacgagatcaccgatccagagaccgcgaccatcacggttccggtgggcgcgcgcgatagtggtgcgccggtgcgcataggcagcgtgcgcgtgcaggccacgccaggcaatacgaatgaagtgcccaaccagcgcaatcattattcgcgagcggccattcaactcaacaccaccggcggccagaccatttcgggcaacacttgggtggattcgcgcgacagcgacggcgtgtgggaagatcggctcaacatactcgactacacaacgaatccggccagccaatacctcatattcggtaagaaactgcagtactacgactcacatgagattcgcgtgcgctacttgggcgacaagggcgatttcgtgctcttcgacagcattcacgcgaatcctgtgatccccttcgagatcaacccgtggcgactgctggtggagctggcattcgccgcgttcttcgtgctcttccgcccccgttccggcatctaccggatgcgggtcgatgagcggcgcgtgaggcagaacctcgccatcgccggctatgtcgtggcatggtcggcgatcatcgtcgccatcgccagattcgccatgcccaaaccgagcggtctgaacaccggtttcatgcattgggtggattacgagcaataccaacggctggcggacgccctcatccatggccacacctggctcgatctcaaggtggatcccgcgctcaccaccatggccaatccctacgactacttcgcccgtcgcagcatcgccgccgacggcacgcacaccttctattgggatcacgcctactacaacggccattactactgctatttcggcgtggtcccggcattgctcaccttcgtgccgttccagctcgtcaccggccattggatgcccacatgggccgcgatgggtgtgttcaccacactcgccgtcgtattcggcacgctgctggtgcgccgtctcgcccgcgattacttcccgaaggcctcactcggcgtcgtgtggctcgtcatcatagggttcaacgtcgccaccaatctgttcgtctacgtctacagtccgaatttctatggaatgccgatcaactgttcgattgccgtgacgctcgtgggcctatggttctggcaggtgtcgaaacggcccgacggcaccgtcaatccttggctcatcgccgccggctcgctgtgcatggcgctgaatttcggttcacgcccacagttcatggccgcgtggttgctggcgttcccgttgttctggccgcagatcaccaagctccgcacgctgttctcccgcaaggggctggctcccaccatcgccgcgttcgtgccgttcgcgctcgtcattccgccgctgctcgcatacaattacgtgcggttcggctcgctgttcgatttcggccagaactacaatctcaccggcttcgatatgaccacccgcagcagttcgccatatacagtgctgcccgatctgttcaaccagtggttccagccggtcgacacggccatgcgattcccgttcatcatgcaggtggacacgacgatggccggtccgaacgaaccgtcgattggcggttatttcgccatctacccgcttgcgctgttcgcactgctgttcgttctggtgcgtcgccaactgcgcgcgcatggggtgtgggccatgaccgtcatgatgatggcgctcaccgccgtcgtcgccctgtttgactgctacaagtgcggcacggcaatgcggtattacggcgatttcgcctatctggtcatgctctccgccctgttcgtcgtgctcgcgtatgccacggccgcgcagcacaggcctgccgtgaatctgcacgccaaaggattctcggtgaatcggttcctcggcttccgcacattgcagacgatgctggtgacgctcgtgttcctcacactgctgatcaatctgttcggcttgttcaacgagaacagactcgacgcctggcacggcaccttcagcggcacgtacaccaccgttcgcagctggttcatcggattgacggcgtgaggggagtgaaaacaatggaacagattacagattcccaagtccgatcgaagcgcgggctttgggtggccatcgccgtcgcggtcgtcatcgtcacgttcttcgaagtagggctcttcaatctggggcactggagaacaaccggcctgcagcaggccgtggttggcgagccagtcataggccgcggcctgaagtcgctcggaaacaacgagtatgagatcaccgatcccgagacggcgaccgtcaccgtgccagtcagcgcgcgcgacgggggagggccggtgcgtgtagagagcgtacgtgtgcaggccacgccgaacaacaggaacaacaccgaataccaacagaaccggtatgtcgacggcgcgatcgaactccgtacgactggcggacgcaccatgtccggaaacgagtgggtcagcagccgcgacagcgacggcgtgtggggcgacccgcgcaacgaactgcactatacgacgaatccgagcagccagtacctgctgatcggcaagaaactgcagtattacgattccaccgagattcgggtccgattctacggagacaagggtcataaggtcatcttcgaccgcgtgtacgcgaatcccacgattccatttgaaatcaatccgttcagattactgcttgaaatcgccatcgccgcgttcttcgtcgtgttcagaccgcgttcagcgatctaccggctgcatgtgaacctgcacagcaacaggcaacggtcggccacgaccgtgtacgtggtcgcatggagcgcgctcattgtggccgtcgccgcgctgacgatgcccaggccgtgggggtatgacgccggaacgggccattatgtggatcatgaacagtaccaacggctggcggacgcactcatccatgggcatacgtggctcgatctgccggtcgatccggtattgcagacgatggcgaatccgtacgacttcttcgcgcgccgtggtctggctgcaagcgacggccaccagttcatatgggaccacgcatatttcaatggacgatattactgctatttcggtgtggtcccggcattgctcacgttcgtgccctaccagttgatcaccggccactggatgcccacctgggtggcgatgggaatattctccgcgctcgccgtcgtcttcggcacgctgctggtgcgtcgccttgcacacgactattttccgaaggcctcgctcggcgtcgtatggctcgtgatcatcggtttcaacataggcacgaatctgttcgtatacaacatgagctgcaacttctatggcgtgcccatcgtctgtgcgatcgcgctcgtgctgatgggcctgtggttctggcaggtgtcaaaacggcacgacggctcggtcaatggtcggctcatcggtgctggctcgctgtgcatggcgttgctgctgggctcgcgcccgcagttcgcggccgcctggctgctggcattcccgctgttctgggagcagattacccagcaccgcacgttgttctccaagcgcggcgcatgggggacggcggccgcgctgctcccgttcgtgctcgtgacggttccgctgctgtattacaaccatattcgctttggtgcgtggcttaacttcgggcagaactacaatttcaccggtttcgacctcaccacgcgcagaagtcccctctatatactgccggggcaggtattcaaccagctgttcgaaccggtggccacgacgatgcgcttcccgttcattaccacggtggacaccacgctggctgcaccgaacgagccgtcgatcggcggttatttcgccgtgtacccgctggcgctgttcgccttgctgttcatactcctgcggtaccaactgcgcgaccacaaggtgtgggggctggcctgcacgatgatgaccgtcggtttcatcgtggccgtgtttgactgctacaagggcggcaccacgatgcgctactcgggcgactacgccttctatttcatgctcgccacactgctcgtggtgctcgccttcgactctggcatacagcagggggcaatcgagtctgaagggctggatttggccaagtcccatgaggttccgttcgcggttcgtgactcattggggttccgtacgttggtaacgctgctcgtcgcgctggtgttcttcacgatgctgatcaatctgttcggcctgttcgccaaggggcggcttgcggagtttgcttcggtacgcactggcatgtataccacggtgcgtaactggttcatcggaatgaccgcatgatcccacgatatggcgtcgccgacaacgtgatgcgttgctatctggcgtatttatctgccgctgaaatcgaaaaagccggaaccctaaggttccggctgaagagcggaggatgcgagattcgaactcgcgaggctgttacaccaacacgctttccaagcgtgcgccataggccactaggcgaatcctccagtgtgcttacgcaacttaaatagaatacaacaagctcacgtaagtcacaagtccagcgtgtcgcagtcggggtacgatcgcaccgactgcgccgtgtggcatcagtccatgccgaggtactgcttccagaagcgcatcgactgcatctgcgggccggctgccaaatactcggctgccaggcggtccgcgtgcttcttgtagtaggccatgtcacgcttgtagcgcttcattacctccttgtagcgcttggcgtccttgactcgaatgacgcccttgcgggtggcccaatcgatggcgatgatcacattctcgttgtggatcatgccggcagggtagagccagcccgcacttggaatgatggtgtattccacacggtcgccgtcggaaccgagcgcggtctcaggttcgtctcccctgccgtcgaacctgatcgccacgagcttgtcggtgccgaagcgctgcccgttcttcgtgacgaaatcgaacacccgctgctggaacgaacgcggttcgtcgaaatcgatcacctgacgggtgagcatgtccgggtcgaagtcggtgatgcccatctcggccgcctgcttcttgagctcgtcgaacggcaccagcttctccttctcgcggttcgcccgcatgaaacgctcttgggccaccggctgcatgatgaacttcggccccttgaggaagtcctcgaagccatcgagcgcgagctccgcatcggtgtagttgaatttgcggctttcgagatcgaccatgtggtgcaggctgtggagcatcgtcttcatgctcggcgccaggccggtcaccgcctgcccgatcatctggttgcgcaccgtctggtagcgctccacgccggcattgtagcgaatgtcgaacttcgcgtgccacacgcagatgccgttcatcgtcatgaacttcgggttgcagcggatgccgtattccacgtcgtcgaaacgcacgaagatcggcagcggcaggccgttgcgctcgatcacggtggtcgggatcacgcagtaccaccatgcggcatagcggtgggcgtcctcgggcacgcacacggattcgtcgaagcattcgttgtataccacgtcgacgaacttggtcacttgcagcggcggcttggcgggcacgcacgacccatcataggtggagatgaaaccggtgtcttccttctggtcctgcgtgtcttcgatgttgagcatcgctcccgagacgaaggcctcggcatactcgtcgttcacgatgcgcagcagattgtaagtgcgcagaatgctctccggcgacacctcgacgtcgtcgtccatcaacagcacatgcgtcgcaggggtgctctgctcgagagactcgatcatgccgcgtgcgaagccgccggcgcctcccacattctcgttcggcgtcacaatcacatgctcgtcactcagggcggccgcatcgagcgtgctgccattgtcgatcacgtgcatggtcaaatgcttggcaatgtcgtaatccgaagccagcagctcggtcttcacgagctcgatgttgcgctcgatgaacttctccttgcggaaggttgtcgtcgcaatcgacagttccacatcgcgcggctcaccgtcgaacgacacctcgtagtagccgttacgaatctcggtggcggcggtcgtggcaatctggaatccagccagcacggtgtgctcgtccaccgagatgtccagcgtcaccgtatgccagtcattgtcgccggcgacagtctgggaattgtctttgacaatctccggattcatcgacagacgctcggcgcaggtctgcgtgagcgtgacctcgccggcgcttttcacgtcgatatgcagcgcaaagccggtcgcgcgtgtgtacttttgcaatttgagcacggacagcgcgttgaaatacgtggtgaaatcgacggtgccggcgccattgatcgtccactcgccgttctcgccggacggggtgatcagctgatcagtgtggtaatacatcgttgggtagctcagcgcgcgcggcttggtctccagcagcacgttcgcaaatcgaatcgatggcatgcatcctcacttatgtctacgactatcgaatagttccagcatagtcaggcgaacgaaaaagcatgttctaggcacaagcgcgcggtctatgccattcgttgcggattcgcccattgcggtgctcttgaacagtggcataggtacaatggagcgactgaacccgaaacgaagaaggtgcgagtgaatacgctgagtcaacggttgaaaagccgctacgggtatgccatgaccgtattgcgcggcctggtgaagaccgatttcaagatgcgctaccaagggtcgttcctgggcgtggcatggtctgtgctcaagccgctgatgctgttcgcggtcatgtatgtggtgttcgcgaaattcatgcgtatgacggatggcacgccaacctacccagtcgtgctgctgctcggcatcagctcctggcagttcgtcacggagaccgtgggaatcggcctgcgctcgattgtcgaccgtggcgacctgctgcgcaaagtgcatttcccgaactacatcgtcgtcgtctccgcttcgattggctcgctcatctcgctcgccatcaattatgtggtcattctcatcttcgcgatcttcatgcgcgtgcagttcacttggcgggtgctctggctgccaataaacgtgctggaactgtacatcatcgcgcttgcgctcgcgctgattctgtccacgttctatgtgttctaccgcgatgtgctccatatttgggaagtgctgcagcagatcatcttctatgcgatgccaatcatctacccgttgagcttcatcaccgacaagcaccccgagtatcgtacgatcgccaatctcgaactgatgaatccgattgcgcagacgattcaagacattcgccataatttcattgcaccggctacgcagcccactgtctggaacaccttcggctcctggtgggtgaagatgatccccatcgcaatcaccgtgctgctgctgtggttcggtgtgtacatcttccgtaagaacagccgccgattcgcggaggtaatgtaatgactcaggcaaccgaccacaacaccgacgccgtggagaacggcgacgtcgtcacgatcgacaactacatggacaagcccgtggtgttggacgtggagcatgtggacaaatggttcaagctgcccaccgaacaggccacggggctcaagcaggcgttcatcaactggacaaagggcatcaaaggtttcaagaagcagcaggtgctcaaggacgtcacattccaggtgcatcagggcgagttcttcggcattgtgggccgcaatggcggtggcaagtcgacgctgctcaagatcatctcgcagatctactacccgaaccgcggttcagtgaacgtcaccggcaaactcgtgccgttcatcgagctcggcgtgggcttcaacccggagctcaccggtcgcgagaacgtgtatttgaacggcgcattgctcggtttcacgcccgaggaagtggacgcgatgtacgacgacatcgtggagttcgccgaacttggggagttcatggatcagaagctcaagaactactcgagcggcatgcaggttcgcctggcgttctcggtggccatcaaggcccagggcgacattctcgtgctcgacgaggtgctggccgtgggtgacgaggcattccaacgcaaatgcgatgattacttcaccaaggtgcgtcaggaccccacgaagacggtgattctggtcacgcacgacatgagtgcgatcaaacgctactgcacgcgcgcaatgttcatcaaggacggcgaggttgccgcgataggcgatcgcgagaccgtgtcggagagctacacgctcgccaatctcgaggccattgaccaggagaacgaggagaaggctcgcaaggcgctggaagcggggcatgaggagtacccgaacggcctcaacgaacggtgcccgctgctgcgcacctatggtgtctcaccgctcatgctcaccagtgctgatacgttccggtttgccgtggaataccagttcgacgagaccgacgacttctacctggccatcgcgttgcacgatgttcgccgaggaggcatcaccttcgacaccggtgcgcgcaatccacagatgcacatgacgaagcccggccaccataccgtgtatttcgagatgccgctcgatctgttcaacaacggcgagttccggctcatcacatcgctgcgcacgcccacacccggcgatggcaagatgacggatgccgtggctgtggcattggacgacaacgcctgcacattcgcgattcgtgacccgcgcaactccaactatgcgctcatcaacaaccgtgcactctacatcaagccgatcagtgaggaggaagccgaagacgcggccgccgagcagaaggccgcccgcaaggagactgccgataccgcggccgatgccaacactgtcttcgaaagtgggcaggcgtgagcggcagcgggtcgggaggcccattgaaggccgcgaagcgagcgttctgggagcagatcacacgcctgtataaccgccattacggcgtcaagccactgcccgaaaccgagattgttcgccgatcgaagtgccattacctgatcggtgaggccggttacccgaactacggcgacgagctcattgcgcgtgaatgggtcaagtatctcgcacaggtcgaccccgaagtgcctgtggtgctcgactgcctgtgcgccgggccggctgcggcaatctgctcggggctccacccgaagttctccgtggtggacaccgttgcgcagatgtgcatgatcgatcgcgctcatatttatgatgaacagcatgccgtctccgattccgtggaaccggctgctgccgttgctcccaccatcgaggagattccggttccgcagattgcgaatcgcgttctcgccgcgttggatgccgaggggttggatgcccggtatgccgcaggcattcgtttgctgaacaatcgtgcgcttgacatgcacgtcattggcggcggctatatgcacagtttctggaatgcgaatttggcgcgtctggctgtggcgaaatgggcgcaggcgcatggcaagcctgcggtggtgagtggcgtgggactggagccgctcgatgccgaagatgcggaatgggtggccgatatcgcctcgcatatcactgcattctcatgccgtgatatgccgagtctcgatgccatagattcctcgcattcatacgccacgctggctcccgacgattgctttgtcaatggcttggagggcgtgtacctgcccgatgaggcggcgggagacctccccgagaccatggtttgcgtgcaaacggacttggtgcccgatccggccgctttgctggaccatatggtcgcggtgctccaggcatgggaagcgccggcaggggagcgcgtgggcgttgtggaatgcattccgtacgactcgatggatgcattgcgtgtgattcgcgaccatggatgggagcccgtgctgttcccgctgcagaacctgattgaccacggcttcccggcgcgttccgggcagcggtggctgtccacgcggtatcatccgcacctgctggcggcagcgcgcggttgcagcggcacgttcataccggtgaaacccggttactatgacgtcaagcatgcggccgtgctgcgcatgggctcccgttggacgcagactaccataggcgattcgttgattccgaaaccgggacctggtttcgctgatccgtcggtgcggttcgcataccgtgaccagattcgcgcccaagtcgccccgctctacggcgagccacattcgttcgtgagtctgtaactttgtaagatggtgacgcatgatgctgatgattcgcgagaacgacttggagacggtgctggccaatcgccgcaactttatcggcatcgccccgcgtttggaaagtgcgctcacgatcatcacgggtgtgttctatgtggcatctgcagtggtcatggaagatctctggtggaagattccaatgtacgtgcttggggccattgttactatatatggcattgcaggagtcattcgcaagccttacaccacgaagcagttattcaaggagatcgccggaatgaatgccatcgccagctcgataatcgcaatcacggagcccggcatctccgattccaacaaatatctggtgtattgggacacgaaatggaagtgctggttcttcccgaaccgtcgctccactccgagtgttccggatgacgagcgggaccttcgcaactatcttcatgccgaattcaaggttccgcaagacgattgcacgctggaatacaagacggacggagagagcaccaagtattcgacggaacatgatgagatgcggtactatgattatcgcatctaccgaggggtcgtctccgcgctgccggattcttggtctgttgacgggccgttcgacgtcggcggtcatcgttgcaagtggatgaccattgatgagatgcttgcagatgaggaaacggatcgcatcaaccatgatgtgattgtgctcgtgcgcgacaatgcatgagtgtcgccctgcataagtaaccggagcgagcaatgagttgacatggaatgtccgcacggtttcgagtgtcgtattaaactcggagccgtgcggacgtttcatatgccgtgctggtgactgcagcccgcagtagcccagtgacggcgatgtgtcacctggcgagcaccttgtcgttgagatgatgcaggaatgctgccatgtcttgcctcaccacgttgttcatgccacggaactcgtaggagttgcccactttccagccttcggtgacgccggcgcctgcaagccactgaatgtcggccacatgtggggtcttggcgttcacatccttgaagttgttcttcggagtgacgttcgtgcccttgcccgccttggcggccaatcggtgcaggaatgctgccatgtcccggcgcttgacgttatccatgccgcggaacacataacagccgttcaccagccagccggtggtgatcttgttgtcggccagccactggatatccaccgcatgaggtgtggaatacacgttcacgtcggtgaaccaaactgaaggtgtgaatgtaatctccgccttcaaaggctcatgagtgtaatcgtaggtgtatcgataagtgacgcttccgttaagtttatcgggcatggcgacgccattctcgatttttccgccacgcacatttgaaatcatcgagagatcaatgctcggggcagccgatttaagatttaggatgccgctttgagtcttgtattaatcggtgaaggggctatagatatcgacattgaccgcaggggcgatcgagcttatccaaagcagcgggttggactgaaaatcgaattcagtgagtttggtgtttttgcttacattgattgagatcagcttgttcgagctgagatcgaggtcgcgcagttctgggttcctgctgagatcaattttcgtcagcttattccgggagagattcagattctggagttttgcgttgtggctcaaatctatagaagtcaagagctggttgtacaaatatagattttcgagggttggaaaatacccgatgccctttgcgaacttgatctcatagctgtcaccgccacgaatttcggtgacagcattgcgttctgctatggtgagtttgccgtccttgggatagctgtcgaattcctgtgcaatgcgtacacggaatgctgtatccgggaagtgggctgcatcaattggaatcgtgccgttagctgccattgccgtcggcgccaccatcatcacgcctgccagtgcggcgacagcgctgacggccatctttttgagagtgttcatcatagtcctttctgctgatctctctggtgccgcagagctaagaacgatgctctgtcatgctgccttccattttcagtcgcaaaacttcaaaatgtggcatataggaactaaacgtgttgttttaggtttctagtccgtgctgtttgggtagcgtgtgctggtgtggaattcgttccagtcgatgccggtgccgagggttggttggggcatgtcgttttcttgtggggctgcttgtttcgttttgctcttgcggtcgtgttccttgaggatgcgcgtggggtcggggtcgttgcttttcatgtggcagtgccattcacaggcgcgtctcatgtgttttggtgggagcccgcggtggttgggaagcatgagcttgagcttggcgttgacgccgccctcgagccggttgctgtcgcgggcgacgggcccgtgttcgagtaattcggggtcgaggaagcaaaacagggtgccgttgcggaagaggcgttcgagcctgggataggcgcggcgcagcggcaggtgggtccaccaccatccgcttgtgcttgtggctgccctgggatcgtcgggatggtccttggcgaaggtgcgttcggccagcatcgtcttccagcgttcgtgccatgcgtcgggcgcctcgccccaccgggcggcgtgttcggggtcatggatgcgggcgggcgcgtcggcgggtcccttgagctcccggccggcctcgagccttggcctggaggtcaggtcggccctcgtgtcgcgctgcacgtggatgaggcggcgttggatgcgcgtgcccggccatgcctcggcgcaggccttgccgatgcctttcatgccgtcgcagatgagcacgtcgggaggtgcgatctgttcggacagggccttgtaggcggctgcgctctcacggtcgcaccactgccaggcgagcacctcgccgtcctcgccgtcgatcgcgaccagcaggcaccagccgttcatgtgggtgccgtcggccatgaccgtatgatgcaccacaccgtcgggttcgatgcccggggcgagccccggcaccaacccacgcgtttgcggaagttgcgcgcgctctcacgccgccggcgctggggcgcggccccgagcagccagtcgaggaactcgtccagctggcaccgacgcgccttgtcggccctggacgccgtgggagtgagcgcgcatgtggcgcaacgccgtcgttgagcgcccgaggcgctcctgccgtgtgtgatcatcgcgttgccgcacaccgggcatttgcgcgccctgactgatttcttcctcatgcccgcggcataccccacaccacggaaaacacgccgtattaacgggacggcacaataaagaacacacgacacgcctactgccatatgatatgagcagcaagataaacaacacgtttagttcctatatgccaaatattgatacattgagcggatattcgtgcagccctgatgaggacgcgtgttccctctacaataagcggtggaaacccagatgacttgggaattattcgcggtgtgaaggagtggatggatgggactgcgagtgcggactatgacgaagggcgtgtgcgccggtctgctgactgtggcgatgtgcacaaccgtggcagtgacggcaccctcggcgtgggcgaacgatagcgtggcgccggatgcagccgcgacgcagaccatggaatccacggagaccgccgacgtgcagccacagtggcaaggcgaaggcgagatgcccgacgagctcaaaggcattacaaatcctgagcacatgtggcaggaaggcgccgcccaggagcaatgggaagcggaacaacaggcgaagggcgagcagcagggcgctggcagggccaaggcatccgccggctgttccgcactgtacgactgggacacagcgaatgggtacaagcggttctcctctgcgggaacgggccagaactgtgcggggaagaaggtgttcaatccggccatgaaggtgctggatgtttccgaacaccagaaggtcatcgactggaaccgggtgaagcgttccggtgtcgatgccgtcattctgcgcatcggctacggtcatggcttcgaggacggccatttcaggcggaatctgcaggaagtgcgccgcttgggcatcccgttcggcatctaccactacagctatgcctatgacgtaaacttcgcggtgcaggaaggccagtgggtcgtgcagttgttgcgcaagtacggtgtaaacccgtccgatatggcgttgccggtgttctacgatgtggagcagggggattggggcggtcaccgcatgcccaccaacgccaacgcgttccgcccgatcatcaacgcattcgtgaaccagctcgccagtgctggctatggacgtacatacctgtacacctacctcaactatgcgaacagccgcctgaatgccaatgatctgcgagcccggatcggctggatggcgcagtacagctaccagctcagctacgacttccacagtgggtactccgacgttcgtggttggcagtacacctcgatcgaccgcatctcgggagtcagcggcaacgtggatatgagtgccttcgaccagcgcatcttctccgatgtgaactggaagaccccgcatctgcaagacatcgcatgggcgaagtcctccaaggtgacggacggtttccccaatggaacgttccggggcatgaacacggtggtgaggcaagacatggcggcgttcctgcgtcgtgtggccgtgcggcataacatagcaggcgcgaagacgtggaagccgtcggcggcagattggaaccggttcaccgacgtggatcccggaacgccgcatgcggcggacattctgtggctcgcccatgccggtattgccgatggatacgacaacggcaatggaacccagcggtatgaaggcatggcacccatgtatcggcaggacatggctgccttcctgtatcgcctggctaagaaggcgaacaagctgggtaatgtgcgaccgatgagcttcaccgatgtgaatgcgagtacaccgcattaccaggaagtgcagtggcttgggggttcgggtatttcgcaaggttacagcaatggcaacgggacatggcgttacgagggtatggggcatatgtaccgtcaggacatggtggcattgctgcaccgtttggacgctcgtttgtagttggaggccctgcatttcatcctgtatgcatgatgcccggggaaatcgcctacaatacaaggggtcggcgtatgtgaggagtgacgatgcggatggggcttggattgcacgaatacgggggatggtgcaatccaaacgccgtccgcagggttgcccggcgattgaagactgcggtttgcgcattgctcggctgcgtactcgccatgttcgcgttgaccggttgcggcaatgtgaatggcagcgatcaggcggacgcatggaacgaggcggccgacccgtggtcgtattcgttcggcgtacatgtgttcaccgagggggatggccgcgtgctgcggccggtatggcgggtcatcgacgtcgccgaacatcagcgaaacatcaattggcagaaggtcaagcaatccgaggtcgatgcggcgattctgcgcatcggctacggccatggcaacgaagacaagtatttcaagaacaatctggcccaagtgcgcgtgaaccgcattccgcatggcctgtatttgtacagctacgcctacgacaccgatttcgcgcgcgaagaggcgaatttcgtgctgcaaacgctcaggaggtattcgatcaccgacaagagcgtccctattttctacgacatggagcacctcgacgactggggagggcacacgatgcccacgcggccgattcagttcgaacagattgccaaggtgttcttcggcgtgctcgaggatgcggggtacacgaatctgggaatctacacttacgcgcacaacatggcgacgcgcctcgacagcgactggctgcacggacacgccaactggatcgcctcgtattctgacacgcttgagtatgatttcgcaggctgcccggatctgcacgcatggcaatacacgtcgaccgcgcgtgtgcccggcgtgaccggcgacgtcgatgtgagcgtgttcgacccgcggttcttcgacgtggagtgagtggcgcgatatctgcacacacgggcatatgcagcgtggccggcgtttcacatgaaacaccggccacgctgtgaatatgtcgtgctgtcaccgcggattgcggaagatctgctcccaatgctccacgctggcgatatttgcggccttgtactcggcggcgagccgatcccagcgcttgaagaactccttcgacaggtacaggccgcgcatgaactgcttgcggaacagcggattgttgcgcctgcaccacgatgccgagttgccgtccgcactggtgacaagcaccgaggattgcccttggaaggcgtgccaggtggcatccttggcggggacggcgatggcggggcgttcgtcatgggtgccgtcggttcgtgagatgagtgatttgagcacgaccttgaagcattccttctgcactgcggccttcgacttcggcacggcatggggctcgaactcggccttggcctccgggaaatcggtgagattcggtttgagatcggtgtcggagaatcccttgcgcagctcgcgtaccgtgttcagctgcgtgtgcacggtgtcgagcatgtactgggggccccgcatgacgtcacggagtgcaatgtgccgcagcttgattcccgagtagatgaagcggagccccaggttcgcgtcgccgtaggccatctggtacgccatgatcgggcttggcttttcggcgtgcagcaatgcacacacccagcggttgcggttgttgaaatactcctcccatgtgcggcccggatctttgtcgtgccatgcctgatgccacaccgcgacgcccggcaggctcaccgtatggaatccatgctccttggcgcgcagtccgtattcgatgtcatcgaatttgatgaacgccggcatcgacagaccgatctgtttcatacaggcggtggggatgaggcaaagccaccatccattgaagtccacattgaaccggcggtgcagcttggggcagtcccgtagtgggaactgcgcgtaatcatggttgtattcggcacctactgccgggaacatgcgcatctcgcgcatgtcgacgcgctcgccttgtgcgtacatcaccgtgcggttgtcgaggtggagcatgccgccgcccacaatggtgggcgtgttgcagtaatcggcgaactgcacggcacgaataatcgattcaggttcgctaatggcgtcgtcgtccagaagcagcgtatgcgcgctggtgcctgccttgagcgtctcgtacatgccccgtgaaaaaccgccggagccgccgagattagcttgctggatgtaggtgagctgcgtgccgagttcgtccgccgtctcgtcgaagtccggttggtcgcatacatggtcggtgccctgatcggtgcagtagatcgtgtcgagccgtgcccgtacgtcggcgttggcggcgatggcacgcagctgccgcaggcagtacgacggtcggttgaacgtggtgatcgcaatcgagaatgggtgcaggtcattcggccgttgggcagtaggcacctcccaacaggcgtcggcgatatacaacgccgaagtgtcggtggccttggcgtcgaaccagaagaagccgccatcgagcagtccgtccatgcccatctccacgctgacctcggtgaatgcctgcggggaatcaatcggaacggtctccacggggtgcaggagaccgcgtcccgtggaacgcatgagcgccaatgcgcctgcacccttcacctgtgcggtaaagcgcacggatcgcactggcgtccagcgacgccaatagcttgccgggaatgcattgaaatacgtgcagaacgaggcatgccgaccggtatggattgtgattgccgtgcgaccggtcactgtgaacacggcgtccgaggcattggcgatgggccttttgttcccgttgagcaaccgtcgcagctcggactcgttcattgcgccgaaatccaatgagtagaagtccgcgaatgggttgaccacgtcttcgtcgagtttcggacgtgtccattcgattgcgtacaacggcatcgtcatgtcttcgtcggacgtcgggaacacaacgcgattgaccgtctcccagtcgcccgtgccctgggcggcggctgccgcatggcgcggggtctggcgtttcttcggggtattcactgccatagagttataccttactgcttcggtatgtccatgaagcccatgtccatcaggtagttcttgcccaccgacatgtcgtattggaccatcttgtagtctgcgagcaactgcttggccttgctcgacaacgtgttggtgtcgatgacctccccgttgtcgtcaagcagcgtcggttcgcccttcgcgctccatacgccggcattgaccgagcgagacatcgccggcacctcggcatgcagttcgtcgagcaaggccaggtatggcgagatgcgcgcgttcatatgctcggcagcctgcgtcatgaaataattcgacgacgtgtaggcggcatcagactcgggcagcttcacgtcatgggaagccgaagcgcggttcgaccagatgaaatagttcgtctcatgcaaggtgagtgcattgttcttgtcggcattcgccgtgttgtagatgcccggcagatggtcgccgtagaacacgacggtgatgggcttgtcaatgccatcgagctcattgaggaagtttgccgtggcctcgtccgtgcgctgcacgttcttcgcataggtggcgatgatgccgcgttcgggaacggtgtccggcgtttcgttcacgccgtggaattcgttctcggagccgtagagatctgggtacggggcatggttctgcatcgtgatgagctgaatgtactgtgacggcttgttctgctcggtgttcgtgcgaatctcctcgacgacgttcttgtaggcctcttcgtccgacacttccgtcttcgtgccgttcggcccgacataggcctcgccgtgcgcgatcttcggatcgctgtcgagcgtgtacagatgcgagaacccgaacttcttgtagttcacgccgcgcagatagaagaactgcttgaacgggtggtagccgatcgaacaactcgtcgagtattcgtcgccgcaatgctcgttccacatctggttgaacgagtagaacttcggccgggtggccacgagctgctggtaaggcgagagcagcgtatcgctgaagttggccatgttcaggccggtcatctgctggaactcgatgttcgcagtgccgccgccatagcccggggagagcatgaggcccgaagtggtggtctggccaagcgcgcggatgttcggcatcgggtcggcgccgaagtgcacgttcggcacgcggttcggatcggagaagctttccgagaggatcatgacgaccgtgttgtccgtgagattctgcgaacgctgcgcgttgatctcgtcggcggcctgtgcataccgatttttgatctgctgcatggcagcctgcgaatactcgggctcgtcctccatcgccttgacgcgcgtgagactgaggaacgtggtgagcgcgccattggtctccgcatcctgctgcacattccacagcgtgggcgaatagccgatcttcgacaacgtcttgcgttggggagcctgtgggttcgacagcacgccggcgtacgagatgagcagcagcacacttacgatgggcgcgagaatacggcagatgagaccgaagatgttcttggggcccgcaatcggatgccgccacgagcaatagatgaatgcgcggcgcttatctacacactgcagaatgacgcagatcacgacgaaccataccagccatgctatggccgtattgacgagcggacgcgaatcgtcggtgacgaacgacgcgacgtcgccggcgccgcctccgccaccgccgctcaggaatcccagatccgacgggatgatcggttcgctgcgcatcgtgatcttgattttcgtggccaccgcgaacaccatgacgaatgcgccgaacaacgcggtgcccacccagaatctgttcaccaaggtgacaaggagcaggtagatgagcacgagtgcgatcatattgagatagcacgaggcggaagacaggtaatggtaggcgtctccggtcacctgctgcaggaagttgagctcgctggccgggtcgtatttgagtttcgtgttggtgctccaccacaggaacatggtcgccagaatgaccatcgcgatgaacacgaccgtgtaggcgccgtaggagaacttcggccgtttgttccagatttcgtagaacttcgtctccttgaaccgccgccactgccgcgtcaccggattcactcggcggctgttcttctcccctgtcggttgaggggccgcattctgcacgccggcacggggatgcgccgccttccgggcggcggatggcttcacgttgtcatggtctccgttgcgtgcggtgacatggttcgccacggcaggcatcgcgagggggtcgccggaggatgcggcatgcaaggcgtatgtgttgccagctgccatcgatgtcagatgcctacgatatgccgcgcggatcctggcgcgcctgtgttttgcgcagcggatccgttgcgcgcgtgtacgtggcccatcgtgccgtgcaacgctcttcatgctcattcaacctttcaattatgctgtcacaattgtcgtgcgccgtgccgacggcgtgtggtgccgcgtatgcgctacgatttcggcagttccatgaagcccatggtttccaagtagtttttgcccacgcacatgtcgtattgcacgctgcggtagtctgcaagcagttccttggccttgctcgacaggtcgttctcgtcgatcgggcgcccctgcgcgtcgagcatggtcagcgaggaatcgttcttccactcgccgtcattgcgcccgagccttgccatggccggaatctcatcgtgcaattcggtgagcagtgccaagtacggggagaccttggcattgagatgctcggcggtctgcgccatgaaataattcgaggaagtgtgggccgcattcgctttgtcgagcttcgtcgtatgcgcgtcgctcgccgtgttcgaccagatgaagtagtcggtttcatgcaacgctatgtcgttcttcgggtcggccatggccttcgaatagatgccgggcaaatggtcgccgtagaagacgacggtgatcgggcggtcgattgcatcgagttcctcgagaaaatctgaggtcgccttgtcggtgatctgcacgcccttcgcataggtccgtatggatccgcggtcgcttgcggcgacgtccgtggaggtgtccgcggcgatgaattcgttatccggatactcgtcggcggtatatggagtgtggttctgcatcgtgatgagctcgatgtacttgctccgcgaatccggctgcttcagctcatcgagcacattggcatacgcttgctcgtcggacgtgtacttcgaattgctggtggattcgcggtgcgtgatctgcggtttgctgttgagcgcgtggaaatgcgagaaaccgaacttcgtgtagttcgcgccgcgcaggtacatgttctggtagtacgggtggaatgccaccgaacagtcggtggaaccgtcgcacgccgcgttccacatctggttgaaagagaagaacgtcgggcgattcggtatgagctgctggtacggcgtggcgagcgacggcgcgaaattcgtcatgctcaggccggtgacctgctggaattcgatgttcgccgtgccgccgccgtacccgggcgacaatgcgaggccagacgtcgtcgattgcatgattgaacgcagattcggcatgggatcctcgctgaacgagacacccggcacccgcgtcggatcggcgtaggattccgacagcacgttgatcaccgtgctgtcggtgagtgtggcccggcgctcggtgttgatccgttgcgccgattgcgcgtacttgctgttcaacgcctgcattgccgattcgctgtagtttggatccggctccatcgccttgacgtccacgagactcaggaacgaggtgagcacaccgttgcggttggcgtcagacgtcgtattgaactgctggggcgtgtactcgaaatagtcgaggaaccgtcgcaccgcggaatcctgctgcccgagaccggtggcatatgaggcgagcagtgcgatgctcagaatcggcgcgacgatgcggcagatgaggccgaagatgttccgcttcgaatcaagcgcatgccgccatgagcaatggatgaacatgctccggccgtccaggaactggagtgcgacgcatatgagcacgaacgtcacgatcatcaccacggatggggcgatcatcgagctcagatccgccggtatgaacgacatcaggtccccttcgccgccgccggtgaggaagttgagatcgcttggcagaatgatctcatctcggagcacgcatttgatcacggtcgccaccgcatacaccgcgaacagtgtgaacgttgccgccgtggccgcccagaaccggttgatgagcgtgagcagcacaatgtagaccatcacgatgatgatgagattcatccacccctggttcgtggagagccgggcgtgggccgaattgaaaatctgcgcgacaagcggcccatggccgggatcataccggttgtcggaatccatgctccacagcgccatgtaatcggaccatacgcaggtgagcatgaacaccaccatgtaggcgccatatgagtatttcgggcgtgtgggccaccattgcctcaccgcggcgcagatgtcacgaaacaccgttttcggggtgcatttgtgcgcgtcgattaccggtgtcggcgtctcggcctgatattcctgatcgctcacgcgtaatcctctcagattcggtttagggcaagtgaatggcatatgcgcccgttgtacacaaatatcagtattctattcgctctgcgagatggaaaccgagcgatgcccatttccgtgaggtcttcacaagcagtacgcgaatgagatgtgcatggcgagtggacgtcaccatacgtcacctatacttgcgggtatgcagtattcagtgaccgcagtggtggtgtcgtacaaccgcgccggattgctcgacgaatgcctgtccgcgctcaatgcgcagacccgcaggccggattcactggtcatcgtcgacaacgcgagcaccgacggcgctttgcaggtggcgcgcgatttcgccgggcgcacgccgattcccgcatatattctcgaactgcgcgagaacacgggtggcgccggcggattctgcgcgggcattgcgtacgccgtcgccaacggttccgcggaaccgggaatcgctgaatatgtgtggctgatggacgacgacaccgtgcccacgccgacggccctggagcagctgctcgccgccgcagacgaatgcgtcactgtgaacgatcgcctgcccacggcactcgggtcgaaggcggtgtgggtcgacggccgggaacacctgatgaacaaaccccgcccacgtgccgtcctggcgaagggggagcgcgagatggccggcggtgcgtaccaggtgcgctcgctctccttcgtctcctgcatgctcaatatgggtgcgattcgcgggcgtcgacgtctgccgatcagcgcgttcttcctgtggaacgacgacttcgaatacacgacggctctgctgcgcaatggcgtggggtactatgtgccggcgagcgaggtcgtgcacaagacgaagaaattcggttcgtcggacgccgacccgggccagcgtttctacaacgaggtgcgcaacaagatctggatgctcagattctgccgctcggatttctcgttcggcggcctgctctcattcctcgcgaagaccgcgcgccgctggctactcactgtgatgcgcgccggcgaccgccccctcattctccagtgcctgcgcgacggctggcgtgacggctggcacaccgaaccggagtcgaatgccgagatcttcgcccgtgcatgcccgccgctggtgcccgacatcgagcgcatctccctttagatttcttcaaatctctttaggctcggctctttggctccgcctccctgcgtcatcggagacatgctcctccagataggcagtcatcccctgcgtaatttgggacatctgcgggcctccatctgtctctttttacgcagagtattggtaattgacccgtacgcatctgcgtaaaaagagacagataggcactgaaaatgtcccaaattatgcagattgatatgaatatgatatgaataatcgcgaatcactcggactgggcgtgacgaccgcgcggcttggcctgcacttcggccggcgcgggcgcggccgaaatctcggtgttgcggcgcgagacaatcgaatggtaggcgcgcttgcgcagggaggtgggcatcatgcggtatgcggcgcgaatgaacgtgttgcgcaggaactgtgcgggtgacgtgaaaccgtcgcgcaggaagcgccactgcaaacgcagctcctcgcggaacatgtcccagccgccacggcgttcatacgcctcctgattggtgcggtagagcacaagcggctccggcatgttgaggaactgcgcgtggttgagcatcatgcgctcccacagcaggtagtcctcgaatctgcccgcatcctccgggtagccaccggcggccagcacagcggatttgcggaacacgacgcttgggtgatgcaccggcgactgcatgcgtgcgtatttctccagatcggcgccctcggcaggcagcatgcgaatctgcccgggctggcgctcgtcgtcggtgaattcgcggatcgcgctgcccatcacgtcaatcggcagtttcgacttcaccgtggtgtgcgaggcggcggaacggcgggtgaattgcggaatgatcgtggcgaaccggttcggcagcgacacgtcatcgcagtccgcgcgcgcgacaacgtcgaaatcgcagtgctgcaggccgatgttgagggcatgcgcgagtccgcggttctcgtcgagaggcacgatcgtcacctcgggcacctccagttcggggcgctcggcggtgaaccacaccgccatggtcgactgcagcgtatccaaataccgctgcaccggctcctgaaccgggccgtcacgcacaatcaccacctgattcggcggcagcgtctgctcgatggtgctcgactgcacggaacgctccacctcacgcaacgaattgcccccatacaccgccatgagcagcgtgaagggggcagtcgtctcccggcgttccctgtgtgtcatgcaacctatggtaaaccacggcgggggaagttccgccatgagccgtggctgcattgcatgaatactgtgtgcatattccgcgcgcatgtctgcatatgctccatgtgccatgttcggcgccacatcttcttatgctgccgaatttcgttcgcaggccgcgtaagcattggcattcgcgaatcacgccgcagtgtgcacaccgcgttttatgctggtgacaagtgcccgctgcagactgtttccgtggtgtgcggcgacgaatatgcacatgcggcatgttcgattgatattttcggaaggacttgagatgactgcaaacgagcagaacgcgacgccggatctggtgatcgtcggtgccggaatcttcggcctcaccattgcgcagcaggcggtggagaagctcggcgtgaacgtcacgatcatcgacattcgcgaccacatcggcggcaacgcctactcgtacatggacccggaaaccggcgccgagattcacaaatacggcgcccacctgttccacacgtcgaatagccgcgtgtgggaatatgtgaaccgtttcacgaagttcaccgattacgtgcaccgcgtctacgccacgcacgacggcgaggtgttcccgctgccgatcaatctgggcacgatcaaccagttcttccgcgcgaactacacgcccgcgcaggccaaggcgctcatcgacgagcaggctggcgagctggcaggcacggatccggcgaatctcaacgaccagggcatttcgctcatcgggcgtccgctgtatgaggcgttcatcaagaactacaccgccaagcagtggcagaccgatccgagcgagctgccggcgagcatcatcaagcgtctgccggtgcgtttcaactacaacaaccggtatttcaaagacacgtgggaaggtctgccggcagacggctacaccgcgtggcttgagcgcatgatcgacgacccgcgcatcactgtgaagctggagacggatttcttcgacgagacgcagccgctcaacaagcgcgcgttgttggaagcgggcgtgccggtggtctacacgggcccggtcgaccgctatttcgactacgatctgggcgagctcaagtggcgcaccgtcgacttcaaggaggtgcgttatgacgagggtgaccacttcggctgcgcggtcatgaacttctccgacgccgacgtgccatacacgcgcgccattgaattcaagaacttcaacccggagcgtgccgccgagcagaacccgaacaagaccgtggtgtgggaggaatactcgcgcttcgcgaaccgcgacgacgagccgtattacccgatcaacaccgatgaagacaaggccctgtatgcacagtacaaggcgaaggccgccgacgagccgaatgtggtgttcggaggccgcttgggcacctacgcgtactacgacatggaccaggtgttcaaccaggcgctgatttcctacgagaagcaggttgagccactgctcaagaagtagtttgtatttgtttgtatttgcagattgcgttctgtgaactcgctttctgaatgcggacgggaacccctattcggggttcccgttctgcgttgttgcgctcgtggtgggtttcgtctgtgtggtgtggttggtgtttttgtgtgtgggtgttggttggtgttttggctggttttcgacacgccggtggtggtgttgtgtttgttggggtttgggggtgtgtggttgggggtggggttgcgtgggtgggggttgtggtgtaggtttttcttttgctgccgctcacggcctgccggggttcccgggtcggggttgtgggtgtgtggtggtggtttgagaactcaatagcgtgtactgtactacttgaccaaggttgatgtcgcttcggctgtcgtggccgttgtggttcttggtcgtcttttatgatgccagttccgttgtccgcctgcatggtttcgtgtgggtaatcctgtcgggttttgatggatggcggaggttttttgtgtggctccctttccttattagggggtccgtctgatttcttttgaaatggatttgagagtcgtttttggctttctgcaatgttttttgtggagggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctttctacggagaatatgggcgtgcatggttttgtgcacggttttgtggctggggtttgccgagtgcgatggtttgtcgtcgccgccctggcttgctggcgtggaagagtcgtattggattgtgtggtgtggtgcgtgctgttgggttccctggccgccaccggcccctggtgtggggtgtggttgccagtgtgtcccccaggtcggttgcccggtgcctgttggtgcggggtgggtgtcctggtggggtggtggtttgagaactggatagtggacgcgagcatcggcccgcccgttggggtggggttggtgttcgtactgtgattcggatccgaggaattgttttttcttgggttcgttcgtaatcgtatgggggcgtgccgtgtgtggtgcgtccccgtgatctgatgtcgttctagggtttttcagtagtgctttggtcatggcggccgtgttgtggttgtcgtgatgggcgtatggtggatgccttggcagacagtaccgatgaaggacgtgtggggccgcgatagtcctgggggagccgccgacatggctttgatcccagggtgtccgaatggggcaacccgccagccgtcatgggctggcaccgcacttgtgcggggggtacgcagggaagtgaaacatctcagtacctgcaggagaggatactccgtgagtagtggcgagcgaaagcggatgatggctaaaccgtgcgcgtgtgatacccgtcgggggttgcgcgcatggtgtcgtgggaacgcctgtccaacggccgacgccgttggctgtggtgataaatgcatgcgtgaggcgaaccgggttggataccgggccgtagagggtgatggccccgtagccgtatgcgcgtgcaccatggatggtgtctcccgagtagcgcgggactcgtggaatcccgtgtgaatccgcccggaccgtcgggtaagcctgagtatacctgtctgaccgatagcgtacgagtaccgtgagggaaaggtgaaaagcaccccgggaggggagtgaaagagttcctgaaaccgtgcgcccgcgaaccgtcggagcccccttggtggggtgacggcgtgcctatcgaaaaatgagtctgcgagtcagtggcatgtggcgagcataagccgtgtggtgtatgcgtagcgaaagcgagtcttaaaaggcgtcttttcagtcgcgtgtcctggacccgaagcgggatgatctagccctggtcaggttgaagcgcgggtaagaccgcgtggaggaccgcacccacttaggttgaaaactgaggggatgaactggggttaggggtgaaaggccaatcaaattccgtgatagctggttctcttcgaaatgcatttaggtgcagcgtcggttgattgcgtgtggggggtagagctactggatgcttgcgggcccgtgccgggtaccaacagcaaccaaactccgaatacccatcgcgtctattccggcagtgagtcggcgggggataagctccgtcgtcgagggggagacagccctgaccgtcgtctaaggtccccaagcgcgtgctaagtgggaaaggatgtggagtcgcatagacagccaggaggttggctcagaagcagccatccttgaaagagtgcgtaacagctcactggtctagtggttccgcgccgacaatgtagcggggctcaagcacgccaccgaagacgcggatgcggccgtatggccgtgtggtaggagagcgtcccacaccggggcgaagcggcgggggaacccggccgtggactgtgtgggagtgagaatgcagacatgagtagcgagagcagggtgaggatccctgccgctggaagaccaagggttccagggccacgttcgtcgtccctgggtgagtcgggtcctaaggcgaggccgacaggcgtagtcgaatggatgaacgggtcgatattcccgtaccggctttcggaccgaccaacagcccgtgtgaacaagggccatccgatacggttgatgggggcttcggcctcctgattccgttgctgtttggcctggacgcgcatgggttgagcgtttcaggagtgacgcggacgggtagccggccggggaggtggttttccctggtcaagcgtgtggccccgcccccaggcaaatccgggggcttcatggggtgaggcgtgatgatgggcgctttcatggcgtgatatccggtgatcccgtcggccgagaaaagcttcggcgcgaggtccgttgccgcccgtaccccaaaccgacacaggtggtctggtagagtataccgaagcgatcgagcgaatcctggtcaaggaactcggcaaattgctcccgtgccttcggcataagggagacccccggccgtgccggccccttgcgggtcgtgggcggctgggggtggcacaggccagggggtagcgactgtttaccaaaaacacaggtgcatgccaagacgcaagtcgccgtatatgcactgacgcctgcccggtgccggaaggttaagaggatccatcagcgtcccctcgcgggatgcgaagtggtgaattcaagccccggtaaacggcggtggtaactataaccatcctaaggtagcgaaattccttgtcgggtaagttccgacctgcacgaatggcgtaacgacttccccgctgtctcgaccaggagctcggcgaaattgcagtacgagtaaagatgctcgttaagcgcagaaggacgaaaagaccccgggacctttactataccttggtattggcatcaggtgcggattgtgtagcataggcgggaggcttcgaagccgcggcgccagccgtggtggagccggccagtgaaataccgctctgtccccatctgatgcctaacccggacaagtcagccttgtcggggagagtgcctggcgggtagtttaactggggcggttgcctcccaaagagtaacggaggcgctcaaaggtccgctcggcccggttggcaatcgggtgtcgagtgtaatcgcacaagcgggcttgactgcgagatcgacggatcgagcagggacgaaagtcggagatagtgatccggtgccggcgtacggacgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatcctgaggaggcctgcccatagtacgagaggacctgggtggacgaacctctggtatgccagttgtcgcgccagcggcacggctggttggccacgttcgggagggataaccgctgaaagcatctaagcgggaagcccgctccaagataaggattcctgacaccccccccgggggtgtgtgagaccccatagagaacatgtggttgatagaccggacgtggaagccccgcgaggggtggagccgaccggcactaacggtcgaagacaaccaacaccaccatgacgaagccggaaaaccccggcggcatcacggcggcacgaacaccaagtccctcactcgcgtccacgatccggttcccgaaccgccacccgcagacaggataacagattttgcggcggccatggcccaggggagacgcccggtcccattccgaacccggaagctaagccctggcacggcgatggtactatgcccgagaggacatgggagagtagcacaccgccgcaaccacacttcaccgaaggcccggggaacacacgttccccgggccttccccgtatcccgggcacaacgcagaacccccgacacggacaccgccgaaccgggggagcatatcacaccgcgcgatcttcatcccatgaacacccctccaaaccggaagaacaacaactccctactattttctccccacctacatgcctccaaaccagaggaacaaccgcaatccaatacaatcttcccaattgcctcttcacattgtcatctcctaacattgtcatcttggaatgcaatgctgaacaatccctcgctttgtgcagcgtgccatagaatataactacacacagtacggcaatagatgaggcgaaaatggtgcggcgagtgacgttaagggaagtggcacaggaagcccaggtttccgtagccacggcgtctcttgtgctcaacaacaagccctcgcgtatatcccaacccacgcagcagcgcattcgcgatgtggcgagacgcctgcactacgtggtcaatgagaatgcgcgcggtctggtcaccaatgaaacacgcctcatcgcgctcatcgtgcccgatattgagaatatgttctttgcctcgctatccaaatgcttggaaacggaatgccggcggaacgggtatcagttgttcatctcgaattccgacgacgatcgcacgctggaacgccgactcatgcgcaatttcgtcggacgtgacatagacgggctcttgcttattccatccatagacagctatacggaccgcgcattgctccgcgaccagatctgcgcctccccctgcccgattgtcatcattgacaggctgatcaccgccgacatctgtgacggtgtgggattcgacaacgagctcggtggccgtcttgccgccaaaaaacttctctgcgcgggtcacaggcgattcgcctgcatcaccggcaacaaagacagcgtgaacgcgaatacgcgctgctacggctttttgaagaccttgcaggaacatgaggtgccggcggactccattctcactctcgacggcaattatcgattctcgggtggttatgacgctgccgatgccgtggcagattttggcgccacatgcctgttctgctgcaacgatttgatggcattgggggcaatcgaccgcttccgcgaactcggcattgccattcccgcggatatttcgataatcggttacgacaacattgtcaaacgtttcggtttgctcacgcgcctgaccacggtggaacagaatgtctccgaactcgcttcgcagagttggcaatgcctgtaccggcatattcagcaccatgattccggccggaactgcgcagaggcgaacgatttgctgctgctcgaaccacagttggtcgagggcgacaccgtcgcgcaggcgccgattttccgctgattccagactccccatacaccggctctcaacgtgaggcattagttttcgtgaatctttgccgcctgcatagcgtcgcatcttcttctgttttgcggtataataaacggtagttcttggtaaaacgttttatcaccaactggcgcgtatgcgtcgcaatcaaagaggattgaaggaaggttcccatgaagaagctcattcttgatctcgacaccggtgtcgacgatgcgcttgcgatttcgtatgcgctcggcagcccggaagtcgaactgatcggcatcaccggcacgtacggcaatgtgctcatggagcagggcgtgcgcaatgcgctggccatcaccgaactgctcggtcaccccgaagtgcccgtatacaagggtctgcctcatgccagtacgaaggattccttcgaggtgctgcccatttcggcattcattcacggtgagaacggcatcggagacgcggtgatcccagacccgcagcgtgatgccgaaaccgagccggccgtcgatttcatcatcgatgcggtgaagacctacggtgacgatctggtgtacgttcccaccggcccgcagacgaacatcgccgccgcattccgcaaggctccggagatcgccgagcagctcggcaagatcgtgctgatgggcggcgcgctcacggtgccgggcaatgtgaatgcctggaccgaggcgaacatctcgcaggatcccgatgcggcggactatgtgttccgccatacgaaggatgcgacgatgatcggcctggacgtgacgctgcagacgctgctcacctacaaggagacgcaacgttggcgcgacctcggcaatgccgccggcacgttcctcgccgacatgaccgacttctacatcaaggcatacgagaccaccgcgccccacttgggcggctgtggcctgcacgatccgcttgcggtcggcgtggccgtcgacccgacgctcgtcaccgtgcatccgatcaacatgaaggtcgatgtggaaggcccgactcgcggccgcaccattggcgatgaggaccgtctcaacgacccgcacaagacgatgggagccgcgctcgacgtcgatgtgccgcgcttcctcgacgagttcatgacgcgcatcaccaacgtcgcgaagaacgcatagctgcaagcagaagacaatctgcacccggtctgcatgcagaccacgaatcggaattttcaagcatctgtggaaaagagacatcatgactgcccccaacaacactgcggttgtgcaggaagagcccgttgacctcgaacagcagaacaagatggccgtgcgcgccttgattctgctgctcatcacgttcattctcggcaccttgtgcctgcagggcttcaatcttgtgttcacgaacatcggctccgacgtcggcgctcccgagcaggccgcgctgatcacgagcctgccgagcatcgtgcttggcatcgtctgcttcatctacggttccctcggcgatttcgtctcgctgaagaaactcattgtattcggcttggtcacgttgttcgtgggctcgctgttcgggttcatcgcgaacttcttcttcacgaagaatctgtggaccgtcatcatcgcgcgcatcctgcagaccgcaggcgagcaggtgtctgggtccgtctatctcgtcatcgccacgaagtacctcaagaaggaactcaaggtgatcttcttcggtctgttcaccgcaggctaccaggtctccgcggccatcggcgtgttcgcggccggcctgctcacgtcgatcgcctggcagtacctgttcctcattccggcggtgacgatcgtgttcctgccgttcctgctgcatctgctgccgaaccgccgcggcggttcccagcatgtcgactggctcggcttcacgatcttcggcctcgcctcggcattcctctcgctgttcttctcgtacaacagctggtggatgctcgcggtgtgcgtcgtgctgttcgtgctgttcggcgtgtacattaacaaggcgagcgacccgttcatcacgcccgcgttcttcaagaacacgcgttggctcgccgcgatcatgctcatcgtgctgttctatttcacgaactactgcgtctcgcctatcttcaacacgatgggcacgaccctctacaacatggatgtcacgcaggtctcgcagtacattgtgtgggcgttcatcgtggccgccgtcttcggcaccacctcgggctggatcgtcggcaagatcgggcgcaccacggcgatcgtgctcgcctcgctgctcatgatctgcggattcgtcggttcggcgctgtgcgtgaacacggacttcggactgctcacgctgttcgcgtgcatcttctacgcaggctgcggacttatgtattcgccggttgtctccacggtgctcgatacgctgcctgtcgatgaatccggccgcggcgtcggcatgaacgatctggtgatgaacgtgaccgcttccatcggcatcgccgtcttcggcgcacagctcggcggcacggcgctcgccggcggctccctcaccggtgccaccggaccggctgcggtctactcgaatctgctgatcatcgccgccggcgtggtggtgctcggcctcgtctggttcctggtgttccacaagcacatctaccgcggtgagtccgcgcaggtgcagaaggaagtggagcagccggaggatgtcgaagaggtgctccacccagccaagtgacacggcacctgtgcgcgctgtgtcattgaatggtgagtagtatggtcgttcacctcgatgccgcgtaagcaaacgaccaaacatatatgcgaaggaaatacgatgaatcagattctcgataagctggagcagattcacggatccgtctccgtggtcggttcgatgaacgcagattacacggtgaccaccgagcggctccccgggccgggggagaccgtgaccggcggcccgctacaggtgctgcccggtggcaaatcgggcaatcaggccgccgctgccgccaagctcggcgccaccgtgcgcatgttcggtgcagtgggctccgactcgaatgcggatttcctgctgactcagctcgcatccgccggagtgaacaccgatggcattcgcaaggtgctcggccccagcggcacgacggtgatcactgtggattcccatggcgagaacaccattgtgtattcgccgggttccaacgcgaacgtgacggtggaatacatcgaatcccagcgcgatctgcttaccgcatcgtcggtgctgggactgtgtttggaaagcccgcttgaaacagtgaccgcatgcgcgaccatgtgccatgatgcgggtatgaaggtgctgctcaacgattcgcccttcattgcgacgttgccgtccgaactcattgcgcatgccgacattctgctggtcaatgagcatgagctcgtgcagctgctgcacattgacgagcctgaagatgatgactgggattcgttcgattgggcacaggctcagaaccgtttgagcgagttcggttttgatcaggcgattgtgacgcttggcggcgacggttcggtggtgcttgactccacggtggatccatcgatcatccgcattgccccggtgcgtgtggatgcggtggataccacgggctgcggcgattcgttcatgggcactgtgctggcttcattggccagtggactgagcttggaggagtccgcgcaactggcttcgtatgtgtcggcatatgcggccaccggctatggtgcgcaggcctcctatggcaccgccgcgcagattcgggagcgcttccgctaactgaaatgcgctgtgtctgtttggtggcgtatggggcagccgagccgatgagattcgtcactggatcgcaagcgcccttacgttcctcatctcatcggctcggctgccccatacgccaccaaacagactcctcgtccctcctccaagtgaggtgtctattgcgaggtacgagggggggctagacgggcgaatagaggcataccgtgttgagtggcggcgataggtcgggtgaggctgaggaacgtaaagggcgcttgcgatccagtgacgaagcgtcacccgacccatcaccgccactcaacatgaagggcgcataccgttcaagcgtagatgtgacgcgtgtgcatgtcctcgggaagtccgttgagcagattgctcaccgaacgggattcgaacacggagcggattccagcggcgagcaatggggccgcagacagcaccgtcatgttgggcaggcgcttctcctcggggatcggcaccgtgtcggtgagcacgatctccttgacgccgctgtccttgagtcgctccacggctgggcccgagagcaggccgtgcgtggcgacgagcgtcaccgatttcgcgccgtggtcgtgcagcgtgcgcaccgcctcgcagatcgtgccggccgtgtcgatcatatcgtcgatcaccacgcagtcgcggtccttcacctcaccgatgatgccatgcgcctcggcatggttcggtcgcgtggtgtcgcgggtcttgtgaatgaaggcgagcggcaggccgccgagtttcgcggcccattgctcggagaccttgatgcgccccgcgtccggcgagacgatcgtcgtattgtcgagcggcaggcggtcgcgcatgtagtcgagcagaatcggcatggcggtcaggtggtcgaccggaccgttgaagaagccctgctcctgggccgcgtgcaggtcgacggtcatcacgcggtcggcgccggctgcccgcatgagcgtgaacatgagcttggcggtgatgggttcgcggccgagatgcttcttgtcttgccgcgaatagccgaagaacggggcgacgacggtgatcgagcgtgccgacgcgcgtttggcggcatcgatcatgatgagctgttccatgatccacttgttgatcggttgggtatgcgcctgcatgatgaacacgtccgcgccgcggatcggctccgtgtagcgcacgtacatctcgccgttcgcgaagtcgtaggccgtcgtcggaagcacctcggtgccgaggtagtgggcggtctcggtggcttgctccgggtaagcacgacccgtcaccaaagccaagcgtttatcgggggtgccttcaagaacagcagacatcattcgcctttcacattgcttgcgaacacaaaaatggagcaccccccaatataacaatgtgcatgtatgtgtgcgcgtgtccgaacgcataggtatatttgagaagttgccgtctgcgaatgtcgcggccggcttacgcaaacacactcctgtcgcggaagtcccgcggccgataagtccgaaggaggtgggtgatgtctgcgcacaattacgaactgatgttcattgccgatcctgaactggatgagaacggtctcaagaagctgaccaatcagcacatggaaatcgtcaccaaggaaggcggttccgtcgagaacatcgacatctggggccgtcgcaagctcgcttacgagattgatggcaagaccgagggcaactacgtcgtcgtgacgtactcctgcgagccggctaccaacgacgagctcgaccgtgttctcaacctgaacgaatccatcgtccgtacgaagattcttcgcaagtaacaagttttcgaaatccgtataggtaagaaggaacgctatggcaggtgaaacgatcatcaccgtcgtgggcaacctgacccgcgacccggaactgcgcaccgtcggcaatggctcgacggtggtcaatttcaccattgcttcgtccacgcgtacgttcaaccgcaacaccaaccagtgggatgatggcgacacattgttcctcaactgctcggcttgggactcggcacgtacgtcgatggccacgaacattgcgaactcgctgtcgaagggcatgcgagtgattgcccaggggcgccttacccagcgttcgtaccaggcacaggatggttcccagcgcagcgttgtggaactgcgtgtcgacgagattggccccgcgctgtcccgtgcgaccgcccaggtgacccgccagacgagctccggcttcaatggcggccagcagggtggcggctacggcaacaacggcggcggttaccagggtggcgcaggctactccggtggcggcttcaacggcggcaatggtgggtatcagggcggtgcgtccgctcctgcaccgcaggccccgtcagcgccggtctccgacccatggtcgaacgattccggctcctccaacgccttcggttcgttcggcacctccgatttcggtggtgactccgacgagcccgagttctgacgcctacccaagtatttcgattttccacgtgtaaggagacaacaagaatgtcacgcaagaggccgcagccaccggtcaagccgttcaagaagaagccgaatccgctcaaggccgccaagatcaccgagattgactacaaggacgttgcgctgctgcgcaagttcatttccgatcgcggcaagattcgttcccgtcgtattaccggcgtcaccgttcaggagcagcgcaagatcgcgaccgcgatcaagaacgctcgcgagatggctctgctgccatacgccaccaacggccgctgagttgtgaggagagtatagatatggccactaccaagatcattctcaagaagtccgtgaacaacctgggccacgccggcgacatcgtcgaggtcaaggctggttacgcacgcaactacctcattcctcagggctatgccttcccgtggaccaagggtgccgccgctcaggccgaggccatgaagcgcgcacgcttggccaaggccatcgccacccgtgagggtgccgttgaggcaaagcagatcatcgaaggcaccgccgtcgagatctttgccaaggtttccgagtcaggcaagctgttcggcggcatctccaacgagcagatcgccaacgcgcttgccgagaaggtcgccgtcgatccgaagggcatcaccgtcgagaagattcagaccctcggtgagttcccggcaaccgtggccctgcacccggagatctccgccaacttcttcgtgaaggttgtcgctgagtaatccggcccatagactcatgaccggctccggtcggtctcaaccagtctgagcttaagcattgaaggcccctgtgactgtacacggtcacaggggcctttgtatatggcccatgcctgcgccctcccctgtacaatgaagtcgtatccgccgcgagttcctccgtgcgctccggcgatggtataagagaaagaaggccccgtgcagtgcccacattgcggtagcccgcccaatgcggatgatgcggtatgcccggtgtgtggaaagcccgtgcaggaatcgcagtccacccatacggaacacaggattcaaccggtggcgttcgaggcgacgacgaccgcggtgatgcagccgatccgcatgcaggaatcgcaacagcgtccgctggtgacgaacatgaacagtccggcgttgccaccttcgttgcctcctgcagagtctgcgagaaggagggtgccggccaggacggcaactgcggcagcaggcgagccggtcaacgattcggcggtgcctcgcaccggacgagcgcacgcatccacagcaacacggaacggcaggcatgtgtggatcatcgtcgccatcgtactgattgtggccatactggccggaatcggtgtgtgggcgtggaggacgcagccgaggccgcatccggatgcgtctgcgcagcaaccgacgagcgaagtgcagccgacgccgagtgaatccatggacggcggcgaaaccggcggtgcagcagacgaggaacacccgcgggaatctgcagccgaacaacaggcgtacgacgagctgcagcggcaggtggaggccgacaaagcgaaggcggccggtctgctcaacgtgtacacaacccagttgtcaagcaagaagccgggcctgcaggcggcgggcagaacgtggacgtatgagacgatcctcggacaataccgtgagctcaaggcaaagtacccgaatgcattgctcgtatggggtcccgattacacgaactactcccgctcggggcacccctcggattactacgtcatgctgagcggcgagacgtttgccacggcacaggccgcgaaaggctggtgcactgccaacggatacggcagtgaggactgtcttccggtgcacctggcgcaatagccggcgaccctatctcgccgaatggccgcaagcgggaagcactgggcagttggcggcagaatgcgacacgccgggatttgcatcttccgtgaatctgagtatatttatctcttggttcaagcaaccaagcccctttagctcagttggttagagcatctgactcttaatcagagtgtccagggttcgagtccctgagggggcacctcaatggaagaccccagcttcggctggggcctttcgtatttgccggttcggtgtgtttcccgatgggccgggatcgttggcgggtgccattcgcagtgtccatattgtgcttgctgtgggcagaaaatattcgtatatgtgggcatattgtgaagggcaaaacgaacagacaaaatgtgaggttctgacgaattaccggcatctcgcatgagtcggagctgaggaaaggaggatcgccatgttcaacagatgggagtccacgacgactgcccttgacaagctgatgatggaaactgcgcagggtgcgcagcaggattccaacgatcatgggaatctggactactgaggtgaatgacgcacctcgggtgctaggagaatctgaatgaagctcgcgaattcgcgagtttttgtttttgcggcaaatgcgggcgcacaaggaagtcacccgcgatggtctgcgcgatacgatggcatgccacgaccggcgaatccagtggccatatgcggggagacaatgcggggtgtgcggcagtggggccgctagtatgggcatgagttacaacggtggaacattacggtaaggagtggcatgaaacggtatgcggttgaatggatcatctttgcgttgggtgtgatcgcgctcggtggcgtgatgatcggcctgccggagatggacaaggtgtggctgtgggtgctgtggggcgccctggcattgtgggtggcggcgtatgtctatgtgctgcggttctgcacgacaggcttcagggcgctgtccattgtggtgtatgtgctcgcctgggtgctcatcgcggcccgtgtcgggctgttcgagctgggctccatgccgcaggatgcggcgacgagcctgtccgatctgctgctggcgggcgtgctgatcctcgtctcactgggttggatccgcgacccgcgttcgaacgaggagcactgaatagcgttccgcataacgcgcgcattccatacgctggacatgcgcgcgttttttcatgccgttcgaccagtgctggacgtacactgaattcgcccacgacacaacgtgtttgccagacgccgtgggaatcaagagaagaagacaaggatttcccggtggaatactcactgtttaccaagttggccgccgagttcgtgggcaccgctgtgctcatgatcttcggcaacggcgcagtagcgaacgtcgagctcaagaatacgaagggccacaatgcgggctggctgaacatcgccatgggctacggcttcggcgtcatgttcccggtgctcatgttcggtggcgtctccggcgcgcacatcaacccggcgatgacgatcgcgcaggcggtcaatggcatgttcccgtggtcgaacgtgctgccgtacatcatcgcgcagattctcggcgccgcggtgggccagctcatcgtgtacgtgtgctactacccgcactacaaggagaccgagaacgccgaggcgatcctctcgaccttctgcacgaccgacgcgcaggccacgcgccgcaactacttcatcaacgagttcttcggcacgatgatcctcgtgctcggcgcgctgtgctgcctcgagttgcagtggggccgccagaactacgcgtcggcctcgatcgtcgtcggcttcatcgtctggggcctcgtgtgctccatgggcggcccgaccggccccggcctcaacccggcccgcgacctgatgccgcgcgtgctgcattcgatcctgccgatcccgcacaagggttcctcccgttggaacgaggcgtggatcccggtcgtcgcgccgatcatcggcggcatcatcggctgctggctctttcacgtgctcttcgccatctgatatgcccggcattcggttgccggcatgcatgcaaaccgcaccttcgggtgcggttttttgtattcggtgtatccgcgcggaatgcgcgcatgcgggcgtctgccctcggttcacagccggacggaatgcggtggtgtgaccgtatactggagcgtatgaccggctcgcacaaacagaactccatacgctcttcgcggcagtcgtcgccgcgaaggaaacggcgcctgccgaagcgtgtgtatatcatgcgccgcgtggtggttctgctcgtcaccgtgctctggatcgtgttcgtctggctgagcgtggcaggcgaggcgcgggccctgttccaagcgcgcaatctgcaggcctcctcgaacgccggggcggcatcgcggtggaagcccacgcattttcacgacgcccagatcgagcgggcgaacaccgagcggagcgaatcggcggagcacagcgagaacacgcatgccgagcaggacgcgcaggcgatcgccgcactcgaggcgccgctgagtgacgaacaacgccatgagattctcgacaaggcgaggcaggcggcatacgaagataacaagacgccggtcgtcctgcattactgcgtggccacgaacggcaatgtgggctcggccgaaggattcgccaacacggtgttccgcgtgctgaacaatccgcagggctggccgcgcgcgggcgtcatattcgcgccgacccacgacacgaatgcctgcgagttcacgatcatgctcgccgaatcaagcaagctggccgaatattcgcagggttgctctgcagaatacagctgccgtgtgggaaccgacgtgatcatcaacaagaagcgttgggacgaggccgtcgaacactggtttgcacatggcgagacgctctcgcagtaccgcacgatggtgctcaaccatgaggtgggccatgtgctcggccacgtcgacaacgagaccgtgtgcgagggcgagggcaagagggcgccgctcatgcaggagcagtcgatggacttgcgcggctgcactccgaacgcatggccgctcgacaacgagttgtggacggcgtactgatggccggccgttttgctcccaccccgtcggggcgcatgcatttgggcaacgcgttcgccatgctcgccgcgtggctttccgcacggtcgcgccatgagccgatctatttgcgcatcgaggacatcgacaccccacgtgtgctccccggcgccgaccgcatgatcatggacgatctcacttggctcggcttggactgggacggcgaacctgtgtatcaatccgcgcggcaagcggtatacgatgccgtgttcgaacgcctgcgctcgcttgacggtgacgcgctgctctacccgtgcttctgctcgcgtgcggagatccgcgccgcaagcgccccgcaggagggcgacggattcctggtgtacccgggcacctgccgacgtctgcgtgatgaggatcgggacgaggtggaacgccggctcgctgccggtcggcgtcattcatggcgcctggcggtgcccggtgcgcaggagcccggcgccttcgtcgcattcgacgaccttgtgtatggcgcgcagtcgttcaatgtgggccgcgagctgggcgatgtgattctgcgccgttccgacggcctgtatgcgtaccagttcgtggtgacggtggacgacttgctcatgggcgtgagcgacgtggtgcgcggccgtgacctgctgcgttccaccgcattgcagatctggctgcgtgggcagatgcttcgcaccggtttgggctcgcacaatctgccggccgccgacccgcagtatgcgcatgtgccgttgctcgacaacgccgccggcgtgcgccttgccaaacgcgaacgctcgctcgacctggggcgcctgcgcgaggccggtgtgcgcccggatcaggtgatcgggtactgcgcatggcatatgggcctatgcgagggggtgctggaacgcccggaggcaatgtcggcgcagcaggcgctgaatctgttctcatggcggaaagtgcggcggcatgcgggcgacgtcgtggtgccggggaacattgtggaggtgttgcgcgcgctgtgatgttcggattttgcacgggtgccgcgcggggcatgcgagcataggcaaattgcgctattgtgacctgtgaggaaagctttggacacggaaggtgggggtggaatgactgcatatatggatcacaaggatctggcgaacgaggtcattgacgaggtccgtgcacagcagatcgccgatggcgtgcatcgtgtgatggaccgcattgccgctgccgaggagcgtgcagggcgtccggccggcgatgtcaggttgctcgccgccacgaagacgcgcgacgtgggcgagatcatggccgccattgacgccggtgtgccgatgatcggcgagaaccggccgcaggaggtcgtggcgaagatcgacggcctgcgctaccagtgcaagcagcgtgggtatgtgatcggcgcgtatgacttcgacctgacggtcgatgccgacccgacctatgccgagccggaggatctcaaggaggccccgttcataccattccatttgatcggccagctgcagagcaacaagatcagcaagatcctgcccaccgtcaacacggtcgagtcggtggactcgcttgaattggcggagaagatcgcgcgtcgttgcatggtgcgcggccgcagcatgggcgtgctactcgaggtgaacgaatccggtgaggagtcgaaatccgggtgcgcgcccgaccaggcattggagcttgccgagcagattgccgccttggggggcgttgaactgcagggattgatgacggtgggcgcgcatgtgcgcgacgagcgtcgcattcgcgagggattcgcacacctgcgcggcctgcgcgagcgcatccagtcactcggcatgcccggcaccgcgcgttgtgtggaactgtcgatgggcatgagcggcgatctcgagtatgcgatcgccgagggggcgacgatcgtgcgcgtggggtccgccatcttcggcgaacgcgacttcaagtgaggccgattcggcgttgctgccggattggatatgggggtgacgatgcgtaggaagcgtaggaatggcggcgaggggaccgctgcccggcaatggcagccgctcacgttcgaacaggcgaccgacgtcgccgatgtggtgcagttgcgcaggtcgttgcgccggcgcatgatcgcattgcgcgtgttcgccatagtgcttgccatcgtcgccgtggtggtgggcgccacgcccttcgtgctccaatggaggtcgtcgcagcagctctccgcccaaacgcgaatggtgaaccagcgtgtgctcggatggccctacccgcaggcggagaacaagctgagggatgcgcgggcgtacaaccagcgccttgcggcgagcggacagccgattctgggtgaggccgtcgacccgttctcgcagcgggccggtgggtcgagcgtgtcggagaagggtgattccgcggcgagcaaggactccgaataccagtcgctgctcgacaccggcggcggcatcatggggtcggtgagcattccgaagatcagcgtgaacctgcccatataccacggtacgtcggaggaggcgctcgccgcgggggcggggcatttgtatggcacgagcctgcctgcgggcggcctgaacacgcatgcggtgatcaccggccaccgtggcctggtggatgcccccatgttcacgagactcgatgagatcaaaaacggcgactacttctacatagatgtgatgggcgaaaaactcgcgtacgccgtggattccatcaccgtgatcaacccagacgacacgtcccggctgagggtggtgccgggggaggaccgcgtgacattgatgacgtgtacgccgtatggcgtgaacacgcagcggttgctcgtctcagggcatcgcgtttcgattccgtaccccgctccgaacccgtcggatgtgcatgacgggcgcttggtgggaatcatggcggcgattgtggcgttggcgatcggattgattgcggccacatggttctcgcgcgcccgcacacgcgtggaacggatgcgccatgcgcgtcccgacgatgtcatgtccgaataatggactccggagtggactatttggtggttgacggcgtgcagccgctggggatctacttggatttgtgaaatatggttgaaatatatgcggcgtctacggtttgaaattgttgacgagggtatatcttgagggtatcaatttggtaagatatgggcataaacctttaatctaacggcgaattgaaccccttgaatagagtgtgtctaccgcgaaaaaagccgtgtatgctcgattcaagattgatttgttcgatcagactgatttcagtgggggaagtatgaagagattgaagcaccgctccgcgcaatctggcgcgagtgatcatgcgggaaggaagggcgcgagaccgttgcgcagtgttctcgcatcgttgtgtgcagtggcgatgagcctcggcatggccagcgcgagcgtggccgcctttgccgacgataggcagccggccgcgacggcggacccccaagccgcaaccgcgagtgctgggaacgtggacgctccacagcacaccaagcgaatctccaagaacgatgacgggacatacacgctgagcatggatgtgacgggcaagtccgacgaatccactgagcagcaggtcgtcccgctcgacatcgccctcgtgctggatgtatctggcagtatgaatgaactctcaggcaagctcgtctataatgaggtggagctgctatccatgaatcccatctccacgtattatgtcgagaaagatggaagctaccaagctgtaaggtgttctgcgataagttggggacggtgcacgacatggcaagatcaagattcggctgggcagaagtatacagtcacatataattggatcggaggaccgagtgcgagtgtatcaccagacgtccaattttataaatcgaagcagagcgaggagactcgcttggatgcgttgaaggatgcggtcacgtacttcctggaccaagttgaggatcagaaccagcgtatcaacgaccccggcaagaaggtgcaggtcgcgctgatcaagtatgcaggcaagaactccgataaaatcggcaacgacacgtacaatgaggacgggtataactataactattcccagacggtgcactccttggcttggacgcctgaggatctgcagaaggaacaggccgccgtcaactcgctgaaagcgggcggtgccacgcgagccgacttcggcttgcagcatgcggtcaagcaattgaattcgggccgccccggtgcacagaaactgaccgtcttctatagcgatggttctcccacgtcgagcgacggattcgaagccaagatcgccaacaacgcgatcaaagctgcggcgcagctcaagaacgaccattcccaagttatttccatcggcgccatgccgggagcggatccgagtggtacggataacgccaacaagttcatgaactacgtgtcgagcaactatccgaaagcgcagagcatgagcgaaccccatgaccgagtagaaggaacctactactatgcggtgtccgcccgcaccgatctgcagacgatcttcaaggagatcatcagtatcgtcacgtccggcaccgcgtaccaggatgtgacgatgacggatacactgtcggactacgtcgagttctcgaaaccaaatgcgcagaacttcgacgcggagctggtcatccgtgacaaggatggcaagaaggtggacccgtccgaggtcggattgacagactataccatcgcacagccggggtcgaagacgatatccatctcgttccctcaagggtatgtgttgaaggacggatacacgtattcgttggagtacaagatcgtcccttcggccaaggcctatgaggagtatgcggccaacgtcaatgccggaaaaaacgggtatggcgataccaagggcgatgatgacaccggtgcttcgtcggctaggcagtcaggcttccggagcaacgagagggccacgatcgactacacgccccgcgtggatggcgaacaacagggcccagtcgaaggcactgaatacccgcacccggtcatccaggtcgatactacgcagtttgccaggttgagcatcgacaaggcgtggatcgcgaccaatcctgaacaggacaaggtcactgtggacgtgacgtgcatggacacggatggcaagtgcaccggctattcagacattgacatcagtaagagctcaaactggacgtcgacagtactcatcccgaaagcggctgctgaccgcacatataccgtgaccgaacggccagtggacggattccacacgcattacacgaagccgatcacgattcccgccaatacagccggtgaatacagttcgaccgtgaccaactatccggccgcgatcagcttcaacctgaatcagatccgcgtcggcaagaccgtccaagggacggacaccgatcaggacttcacgttcacgttgtcaccggtcaccgcagaaggtgtgaccaatgcggacggtacgccattcacggacgcgacgctgacactcggcgaccggttcgccaatggcacgcaggtgactggaacctttgctgacacatcgatcaagttggcaaccccacagctcggcgcggatgcgatgtacaccttcaatgtcagggagaacgccccctcccccagcgcaggatgggcagcggacatggacgcggtcacggtgacggtcactgtccacgtccccacggagggggacacgatcccgaccggagtgacctatcgctacggtgtcaacgacactgacgacaccgaatccaacaaggatcttgccgcattcaccaatcactggattgcggtgtcgcagcttccattcaccggtgaacagggtgccacgcctttggcatggctcgcagtcgctggcggtttgggtgcgttggctgtcctgagtgcagtaggcatatccgcttggcgtaggcgtcacatgctctgatgccctatgacttcgtggctgggccaagcaggcccggccgcacctccttcgcctgtgaggcgcaggaacaactgaacagaatatcaagatgtgtgttatgcccctcgcattgcgtcgggcattgcacggcgtgtccgagaggatgcgtgcgttcggggcgtcacagcccatgacacaacagagaaggaatgaacatgaatctcaaacgagtattcgcaggggtggccgccgcggcaacggcgctcggcaccctggcgattggcgcggcaaccgccaatgcagccccactcacaggttctactgaatccatcacgatcaatgaggcattggaaggccagacgttccaggcctaccagttggcgacgttcacggatgccacgggcgcaaatggagtaatcaacgatttggcgatgagcacccctgcagccgcgaatgcggccctgaagaaggccattaacgccctgaatgacgccaatccggcaggttggacgacggatgtggatctgactgccgcgaatgtggtcgacaacaatctggccctgctcgtgaccacgctttcgtcttcgcagctccgtgtgcttgcgaagcagctggcaggtagcggactgaacagcacccatgaggcaacggtggcacctggagcgacatctgccacgattactggtctgcagccgggctggtatcttgtgacctgcactagcggtgctgaggacgctgaagtggcgccggccatcatgccatcgacggtggccgagtacacgtcgatcgcccagaagcccagcggcaccattacgctgggtaagctgaatgtgaagatggtcgtgcctacgccgcataagaccatcgacgccaacgatccgaaagtgctgaaggtcggtgacacgcttcactacaccatcacctccacactgccggcacatgatgcaacgagcaccgtgaaatatcactacatcatcgatacgccgggtctcggcctgaccgtcgataatccagcgacgggtgagaagaacatcaaggtctttgtcaatggtactcagctgactgatggtaccgatttcgtggttcaaggcttcaccggcgctgatttgaacgggactacgatcaccggcactgagggattcccgattcaaggcaatggcaagaacaacatcttcactgtggatttgacagagtatgcaaccgctcatcctgaattggccggcaagcaggtgacggtgacctatgcggccacggtgaacagcgatgcgctggataccgtctccaataaggtcaacgtcggcggagatgaccccactgattggcgaggcaccgaggagatcacacgtgccgtgagccagctccagctcaagaaggttggcgtggaagacactgacaagaacggtgcggcaggcgccaaattccagctcactgatgctcagggcaaagttctcaacttcgtgcagcacacggacaacacctacacctatgcgcccaatggtggcaacgggaccgtcagcaaggttacgtcccaggaggacggcagcatcgtcatctatggtcttcctactggcacgtacaaggtcacggaaaccgatgtgttgagtaggtactcgtccaacttcaaggccgtgttcaacgctactgtcacttctacaaccacggatgatgtcacctcggcatcttggaacttggacacgggtgagaatctgctgggtcttgccacgcaggcctctggtaccgcccccattcaggtgaagaacgtcaagtccatcacgcagctgccgctcaccggtgcggcgggcatcacgatgctggtcgtggtggccctgctgatcggtggagccgccgcgctcatcgctgtgcgctcccacagcctgaagcagcagcttcgcggctgagagatgaactgatatctcgtaataggttgtgcccgcctccttgcgcaaggaggcgggcacaaccatatgtttctccggcttatcggttgccgatgttgtcgacatgcagcgtgtgccagacattgcggtgccgattgtcgcagtggtacattgaaagcagcagatcgaaggtctgggagagggggccaaaggtggcaagcgggggcggcgcgttcagcgtcgaagaggtcgcgtacctgaaaacattgcctgcggtggcggatgccacgcgtaaccgcatcatctacaccgaggagttcaaggtcgactgcgtgctgcggtacgcgcaaggggagtcgccggtccaactgttccgcgaagccgggctcgacccctcgctcattggctacaagcgcatcgaatgcgccatcgcacggtggcgcaggcaaatgaacgtggcggcgacaacggtgaaacaaccccgcggcaagcgaggcaatgccgtcatggccgatctgcgcgcccccacgcatatcgatgcttcgttcgcgccgcaggccattggctcacgtggcgatatacgcgatgtgctgatcgcccagcaggtgcgccgcatcgacgaactggaacgccaggtggacgagctgtcgcgcgaactcaggaagctctcggcaccgcatggcgacgccggttccgacccgatgggtgcgtccggtgaaaccagggcgtagactgaggcgtatgagacttgcacgattttcccgcaatgacacgccgcagtacgccttcgtgcagaaggacgccaccgacggcaaggactacctcgtggtgctcgacgggcaccccctgctccagcaggtgacgccgaccggcgagcgtgtggcgctcgacgaggacggcgtgcgtttgctcgcaccggtcatcccgtcgaaggtgtacgggctcgcgaagaactacgaggcgcatgcgcagttcatgcatgagcacaaccagtcgccgcaggcgcatgcgccggctgagatggtgatcttcacgaagccgtcgacctcggtgatcggcccggacgacccgattgtgtacccgacgtattcgcacgacatgaactacgagcctgaggtggccgtggtcatgggccgcatcgccaagaacgtgccggtggacaaggcgatggactatgtgctcggcttcacctgcgtgaacgacgtgacgttgcgcgacctgcagggctccgacccgatgtggacgcgtgcgaagggcttcgacacctcctgccccctgggcccctggatcgtcacgaaggacgagttcgactggcgcgacgccaggatcggcttcacgctcaacggcgaggatgttcctgcggcgagcggcaccacggcgaatctcatccataacatcgccgagcagattgccggtatctccagcttctccacgctgctgccgggcgatgtgatcatgacgggcacgccgaacgcctcgggcacgctcaagcccggcgatgaggcgattgttcgcgtcgagggcatcggcgaactgcgcaacgtggtcgtgcagggggagtgattccccgcaagctgggtgttcgctgtgatttttgaaggctatccgcataacgcgggtagccttccttcgtttcgcgccacaatggcagtgacatatgtcggcagcgacgctgcggggcatattttaaaacttgagtcagaatcactcaagttttgggaataaccgtgccgggccgttgttgaacatatcagatgacgacttcgcctggtcgcgcattcgcgggcccggcgaaatatggaggatgatatggaacagaaatatacgactttggctcaggaggccttgggcgacgcggtgcagagcgcctcggccgccggcaacccgcaggttgagccgctgcatttgcttgactcgctgctgcgtcaggagaacggtgtcatcggtggtctcatcgaggccgtgggggcgaacaggcagacgatcggcgcgcaggtgcgcaatgccctggtctcgctgccgagcgcttccggctcgtcgaccgcgcaggcttcggccagccgccagctgaccaccgcgttggccgacgccagcaaggaaatgaaggacatgggagatgagtacatctccaccgagcacctgctgctgggcattctcgacgccgccccgaacgaggcggccaagattctcgagcagaacggcatcacggccgacaaggtgcgcgcggccatcccgaacgtgcgcggtggcgccaaggtgacgagcccggacgccgaggcctcgtacaaggcgttggagaagttctccaccgacctgacggcccgtgcccgtgaaggcaagctcgacccggtgatcggcagggatcaggagatccgccgtgtgatccagattctgagccgccgcacgaagaacaacccggtgctgatcggcgagccaggcgtgggcaagaccgccgtcgtggaaggcctcgccgagcgcatcgtggccggcgacgtgccgagcacactgcagaacaagcgcctcatcagcctcgacctgggctccatggtggccgggtccaagtaccgcggcgaattcgaggaacgcctcaagggcgtgcttgacgagatcaagcagtccgacggccagatcatcaccttcatcgacgagatccatacgatcgtcggtgccggtgcggccgaaggctcgatggacgcgggcaatatgctcaagcctatgctggcccgtggcgaactgcgcctgatcggcgccaccacgctcgacgaataccgtgagaacatcgagaaggatccggccctggagcgtcgtttccagcaggtgttcgtgggcgagccgagtgtggaggacacgatcgccattctgcgtggcctgaagcagcgctatgaggcccaccacaaggtgacgatcggcgacgacgcgctcgtggccgccgcaaccctctcgaaccgctacatcaccggtcgtcagctgcccgacaaggccatcgacctggtggacgaggccgctgcgcacctgcgcatggaactcgactcgcagcccgaggagatcgacgagctgcagcgcaaggtgacgcgcctcgaaatggaggagatgcagctgaagaaggccgaggacccggcctccaaggagcgcctcgccaagctccagagcgaactggccgacgcccgcgagaagctcgcaggactcaacgcccgttggaacgccgagaaggaaggccacaacaaggtcggcgacctgcgtgcgcagctcgacgagaagcgcgtcgaggccgacaaggccacgcgtgaaggcgacctggcgaaggcgagccgcattctgtacggtgagatcccggccattcagaagcagctgaccgaagccgagcacgaggccgagaaggaagccgacttcgcccatgaggatgagcccatggtccccgaccatgtggacgccgattcggtggccggcatcgtctccgaatggaccggcattccggtcggccgtctcatgcagggcgagaacgagaaactgctcaacatggaggaatacctcaacaggcgcgtgatcggccagccggaagccgttcgtgcggtctccgacgccgtgcgccgttcgcgtgcaggcctgtccgacccgaatcgcccgaccggttcgttcctgttcatgggcccgaccggcgtgggcaagaccgagctcgccaaggcgctcgccgaattcctgttcgacgacgagaaggccatgatccgcatcgacatgtcggagtacatggagaagtcgtcggtctcgcgtctcatcggcgcagccccgggctatgtcggttacgaggagggcggccagctcaccgaggccgtgcgtcgtcgtccgtattcggtggtgctgttcgacgaggtggagaaggccaattccgaggtcttcgacattctgctgcaggtgctcgatgacggccgcctgaccgatggtcagggccgcaccgtggacttcaagaacacgatcctgatcatgacgtcgaacctcggctcgcagttcctggtcaaccccgacctggatgagcagcagaagaaggacgccgtgatgaacgcggtgcacagccagttccgtccggagttcctcaaccgtctcgacgacatggtgatcttccacccgctcacacgccaggagctcggcaagatcgtcgacctgcaggtcaagcaggtggcttcgcgcctcaccgaccgtcgcatcacgctcgacgtcaccgaagcggcacgcgaatggcttgccgacaccggctacgacccggcatacggtgcgcgtccgctgcgccgtctggtgcagaccgaggtgggcgaccagctggcacgcatgctgctcgccggcgagatcaaggacggtgacaccgtgctggtggaccacaccggtggcgagcacctcgagctcaccgaccatacgcacaacccgatggaaggcgacccgaaccctggagactcccagatcacggttgacgacaagaaggatgacggcgaacagaaggacgcctgatccgaatcgccatatggcgactgatatagggaaggcccgcgcaatccgcgcgggccttctgcgtgtttcagggaatctgcaagccttgagtcactacgcccgttccgggttgtagtggcgcatgcgcagcgagttgaccagcacgcacagcgagctgagaatcatcgcgatcgcggcgaacgacgggtcgagcagccacgaggtgaacgggtagagcacgccggcggcaatcgggatgccaatgatgttgaacgcgaaggtccacaccagattctcgcgaatattcgccatcatcgcgtgggagagattgcgcagatcgctcaccgccatggttgaacgggaatccacgatgacatccgcatggccatgggcttcgccttccttcgcctcgccgacctcgagcgtgatgtcgacggcgtggcgaatgcgctcatcggtcgggccgtcgcccacgaacgccaccaccgggcgttggccgagcgacacggcgagtttgcgcatggaatccacggtggcgagcacgtcgtccacggcgtccgcatcgatgaccgaagtggagacgccggcctgctggagtcggcgaatgtcttcctggcagcgcgatgccgcctcctgcgcgaacagcacgtcggtcaggtgacgggcgatctgcagtgagccaagggaatgaatctgcagaccatggcggcctgcgttctcattcgcgaacacggcggcaagcgtcgccgcccagccgagcgcgcacgggcaggcgatgatgagcaccgagatcgcggtgagcagcgccatcggcagcgccggctgcctgccgaacaacagccatgccacgaacgtccacagggcgatcatgatcacgacgggcacgaacacgaacgagaaacggtccacccacaactgcagcgggaacgccggctgctgcggcagatacaggtcggagacgaggcgcgccagcaacaccagcgtgatcacaatgcccacgatggcgaaatacgacatgcgcatgcccgcgggaaacaggtcgccggcaaagcagatgagcaggccgtaggcgtaggcggcgatcgtgcctatggatgcgagcgtgttcatgttcgggcgacggtccgccagtgacgaccagccgtccacatgcaccgggtagccgctgtagaacatgaccggcgtgatgagcaccgcctgccaccatgggtccacgaggggtccgagcgggcaatgcggggcgaaggtgtgaatgagaatcggaatcaccacgacgagcgtgagcgccgcgcccacaatgatctgcttgcgcaatatgcgcaggtccgcggcgttgtcgcgccgccgtgtgcgcaacgtgtcgccggcggacacaggtgcggcctcgtcgtgcggcggctggtggaacagctccccctgctgtttgtgggtttcctcgccaaagaagaagcggatgtgcgcaatggtgagcatgatcgccaccaccacgcagaccgccgcgatgaatgtgttgagagtcatggcacttcctgttcggcttcgtgtatacccatactgtacgcggaagcgctgagcattcccatacgtcgcggggatgagcatgcgcattgcggacctggcggcgaaatcgggttcgcggattactctggaaccatgagtcagtcacagggattccgccccaccggcgtttcgaacagcgagcaggccgccagccgcaccgtcagccgcgaggaggcggtggatttctccgccatggagccgcgcgaacagctcaaacgaatgctgcgcgagcatatggcggaccggccgttctccgagttgtccgacgtcacgttcgactcccatggcgcctcgctgatcggccatattctgctcgacacgatcgaggaagccggttattcggtggatgatttcgacgcggtgggcgcgctgaccgccgcggccgtgccgatggtgtgcgcgatgatgcacgcggccgcctcgcgtggcgaggacctcaacggtttcgtgatggacttcgtgttcccctcgatcaaagggccgtccatcgaaggcaagcgcgtgctgctgctcgacgcatggctgtcggagaagtcgtatgtgcagacctcttcgctcgtcacattgcgcaacggcaacgaactgagcctcgacttcggcatcgttgaggcccagggcgccgaagtggtggccgtggcctcgctcattggcggtgtggatatggtggatccggtgatccgcgtggtgaatccggccgacgacagcacggcggaactgccgttcatcgaggtgttccgggaatccgagctgcactgagctgcgctgatctgcactggaagccgaaaagggagggaatgggccatgcatgagccgaatccgatcgatgtgctggccaaggcctccggcgagcctgaattccgtgaggtgggggtcggcccatgggccgagatgcacctgcaggagccgcgcccggacgaccccagattcgatgccgcgttgctcgacgaaggcgaccgccgcaacgtgctcgaccggtaccggtactggtcggtcgaggcgatcaaggccgatttggacgcccgcgggcgccatatgttcgaagtggccgtggagaactggacgcacgacttcaacatcggttcaatggtgcgcacggcgaatgccttcacggcgaaccgcgtgcacatcgtgggtccgcacaaatggaaccgcaaaggcgcgctcatgaccgagctgtaccagcatgtggtgcatcacccgtcgattcgcgcctgcgtggacgattggcacgcgcgcatcgcacaggaacgcaccgaggcgcgccagcgcatcgagacggcgcagacggcggcccaagccggcgtgctgagtcccgctgacgccgcccgcgaactggtgtacgcgcggcacgacctgaacattgcgcagaacgccaaggtgatcgccatggacatcatcgacggcgcggtgcccatggagacctaccgcttccccgaacgctgcctgctgctgttcggcgccgagggaccgggcctgtcgaagaaggcgctcgagttggccgacgacgtcgtgtacatcagccaattcggctcggtgcgctccatcaacgccggtgcggcggccgccgtgaccatgcatgcgtggatcgcgcagcatgcccacattgcgtagtccgacaccgtatatctgctcacatcgcacagtctgcccacattgcagtgtcccgcgctgcgcagtgggacgccatctgttcgcacccgtacgcgtatggcgtacgccacgggcattcgcagccacgggtgtctggcaaaagtggacaggtggccgcatccgacggcgttggcgtgatactgtgcccgggtgattgaaatacaaggcgttacgaaaatgtctggcgccaagtaagtgctcgacgcaaaatacgcgccgaaaagcaggtccgcatacgcatacctgtgctcgctcgcatatacgaacaacatctcgaaatcgcgcgtcgacgaagtgatggacctcaccggcccggccagtgtgaaaaagacgaaggcgggcagattctcgctcggcatgagccagagactcgccatcgccgcatcgctgctcggcgacccgaagaacctcgtgctcgatgaaccggtgaacggactcgacgccgaaggcgtcaaatgggtgcgcgacctgtgccgcaattgcgcggccgaggggcgcgccgtgctgctgagctcgcatctgatgagcgaggtggcgctcacggccgacaatctggtcatcattggcgaaggccgcattttgcagacgaccacagtgagtgatttcgtggaggagcattcgcgcgatctgctctccgtggtgacgcccgatgccgagcgcatgcaggcgatgttcgcgaactcgccgagcgtgcgcatcacggagaccaccgtggaagacggctacccggcggactcgcgcgcattcagaatcgaaggcgccgatttcgccgccgtcgcgcatggcttcgcgcgctcgcagatcgtcgcgtaccggttcacgcgcgagcaggtctcgctcgaacaggcatacatggaactcacgcacgcgcatgcacagtatgtgagcgcgccgatgacggcggccggtgcgcagattccgcagaacatgccaatgcagaacatgccggtgcagaacatggggaacggaggggcgcgatgagtggtgccatgcaatcagcgaatccaacgggaacgccgtcaggaacggtccccggtgcggcacatggcgcagcgcatggtgcgtcgcatgccaggcgactgggctttggcggcgcattgcgagcggaatggtgcaaggtgtggagcgtgacgtccacctacgtgctgttggtgctcgccattgtgttcttcgccgtcaacagcctgatgatgggttggctcatgaggttcgtggaatcgcagggcgacggcatgccgctcggcaacgaggacctgtgggccgcggtcagttccggcgccgacaacgtgctcctgatcgtcggcattctcggcgtgatggtgctcaccagcgagttctcgagttcgtcgatcatcacgtcgctcacggtgaacccgcgccgcaccatgttcatgaatgcaaaggcgctggtgctcgccgtcgtgaccttccttgcctccttcgtcggcatgctgctggcgtggggatgcgcggcgatcatgatgggctcgtcggtgagcaccggcaatgccgagatgccggccgcgatgccgtgggtcacgctgcttggcataccgttggcgatggcgttgggcgcggtgatgtcgatgggcttcggtgcgctgtgccgttcgaccgccggcggcgtgctctgcgtggtcgtgctgttcatgatcgtgccgtcgatgctgcagatggtgcagctgctcggcgagaaattcacctgggtggtctccctcaacaactgcctgcctgcgaacgcgctcacctatttcacaggtgtgggcgccaactcgttctcgaacagcgcgagcgcgcaactgtcgatgggcgcgacgcatccgttccagccgagttgggggtgggctggcctgatctacctcgcctgggccgtggtggtctacgccgcaggtgtgatcgtgatggatcggcgcgatgtgaagtgatgtgcgaatgaagtgaggtgaatgagcactcccgaggtggagaggcctgtgatacggggcctcgaccgttttcagtgaaacggtcgaggcctcgtcacatttggttcgtatagttggggctatgcctacattcacacgcgaagaaatagtacatttgggcgatctggcccgaatcgcgctcaccgacgaggaaatcactcgtatgcaaagtgagctcaatgtcattgcagacgccatcgattccgtgcaggaggtcgccacggccgatgtggagccgacggcgaaccctgtgccgcttgaggcctacctgcgccccgacgttcctgcgacaccgttgacgcaggccgaggcgctgtccggagcccctgttgccgaggacggcatgttcgtggcacctcgaattctgggggaggagtgatatgacgaataccgccacaatcgaactggtgaagctctcggccgttcagatggccgaactgttgcgttccaaggaggtgtcgagccgtgacttggtgaacgccgagctcgaggtgatcgacgccgcggagcccacgatcaaggcgttcctcaaggtcgccggcgaggccgcgctggagcaggccgacgccttcgacaatctttcggatgccgagaaggccgaactgccggagcttgccggtgtgccgatcgccatcaaagacatgatcgtgacgaagggcatcgagaccacggcggcctcgcgcattctcgagggctgggttcccccgtacgatgccacggtgatcgagaagctcaaggcggcgcatatgccgttgctgggcaagacgaacctcgatgagttcgcgcagggctcctccaccgagcattccgcctaccagcatacggccaatccgtgggatgtcgagcgcgtgcccggcggctccggcggcggctccgcggctgccgtgagcgccttcgaggcaccgttggccctgggcaccgacaccggcggctccattcgccagccgggcgcattgaccggtaccgttggcgtcaagcccacctatggcggcgtctcccgtttcggcgccatagccatggcctcctcgctcgaccagattggcccggtctcgcgcaccgtgctcgattccgcattgctgcaggagatcatcggcggtcatgacaagcgtgactccacgtcgattccgcaggggccgcgccccatggccaaagccgcccgcgagggcatgaaccgcgacctgaagggcatgcggatcggcttggtgaaggagctcggcggcgaaggcttccagcccggtgtcgaggcgcgcttcaacgaggccgtgaagaaactcgaggcgatgggtgccgaggtcgtcgaggtctcctgcccgcgcttcaagtacgctctgggcgcctattacatcatcatgccgtcggaggtgagctcgaatctcgcccgctacgacggcatgcgctatggcctgcgcgtgatgcccccgaaggatgtggcgcagacggcggccaacatgatggcctacacccgtgaggccggcttcggcgacgaagtcaagcgccgcatcatcctgggcacctatgcgctgtccgcaggctattacgacgcatggtacggctccgcgcagaaggtgcgcacgctcatcatcgaggacttcgagaacgccttcaagcaggccgatgtgctcatctccccgacgagcccgagcaccgcgttcaagttcggtgagaaaatggacgacccgctggccatgtacatgaacgacatcgccaccattccggccaacctcgccggcgtgcccgccatgagcatcccggccggcctgtcggacgacggtctgccggtgggcatccagttcatcgccccgcagcagcgcgacgaagtgatgtacaagccggccgccgcattggaggccgcgctggaagatgagtggaacgggccgatcttcaagtcgctgaagaccccatggctcgattcgatcaacgactgaaggcggaggaaagttagattatggctgaaaagttgatgaagtattccgaagccgtcaaggaattcgacccggttatcggtttggaaacccacgttgagctgagcacacgcaccaagctgttctgcccggcacccatctcgttcggcgccgagccgaacactgagctcacgccggtgagcctcggtttgccgggttcgctgccggtgctcaatgccaccgcggtggactacgcgatcaagctcggtctggccctgcactgccagatcaacgagtggagccagttctcccgcaagaactacttctacccggatatgccgcgtgactaccagatctcgcagtacgacaagccgacgaacggcgaaggctacctcgatgtcgagctcgaagacggctccgtgttccgcgtgccgatcgagcgcgcgcacattgaagacgacgccggcaagaacacgcatgtgggcggcgccgacggccgcatcgaaggcgccgaccattcgctcgtcgactacaaccgcgcgggcgtgccgctcatcgagatcgtgacgaagccgatcaccggcgttggcgaccgcggcccggaaatcgcaggtgcatacatgcgtgccatccgtgacatcgtgcgtgcgctcaacatctcgcatgcccgcatggagcagggcaatatgcgtgcggacgtgaacgtctcgctgcgccgttcccccgacgatccattcggcacccgttccgaaacgaagaacgtgaactcgttccgcggcatcgaacgtacggtccagtatgagattcgccgtcaggccgccattctgaacgacggcggcgagatcctgcaggagacgcgccactgggacgaggcctcgcaggccaccgccggcggccgtgtgaagtcggacgccgacgattaccggtacttcccggacccggatctggtgatgctgcacatcaccccggagcacattgaacgcctcaaggccgagatgccggaaatgccgcgtgagcgccgcaaccgcctcaaggccgaatggaagttcagcgatgtggagatgcgcgacgtgatcaacgccgatgcgctcgacctcatcgaggagacggtgaagctcggtgcgtcgcctgccggtgccaagaagtggtggctcggcgagctctcccgcgaggcgaacgccaagggcatctcgctcgaggagctgccgatcaacgcgcaggaagtggccgatgtggagaagctcatcgccgagggcaagctcaacgacaagctcgccaagcagacggtcgcactcgtgctcaagggcgagggcacccctgccgagatcgtggagaagcacggtttcaaggtcgtctccgacgatggcatgctgcagacggccgtcgatgaggccatggcggccaacccggatgtggtggagaagctcaggagcggcaacatgaagccgatgggcgccatcatcggcgcggtcatgcgcgccacgaagggccaggccgatgccaaggcggtcaccaagatcgtcatggagaagatcaagggctgagtctcacccgactacagacaccgtaaggcgcagcggcggcctcaatggcctccgctgcgccttctgcgttccaccctgcacccggtcttctgcgaaagggaatctctgcataacagagaatctctgcgtaaaaggggacggttgatcgcacgtgcttgtctctttttacgtaaatcgatcctcgcgtaaaggaatcctgtgtaaaaagggacgattcgacgcatgcatctgtctctttttacgcagattatcggaagacacggaagatacggaagacgcggaaggcacggaagatttgtacgcatgggggcggtgtgatgggcgaaatagttcgcaagagtgagggcgttgcctcagacaaggcgctagggtaacatataaaggttgaaagatggggatgcccatatacaaggatggaaacgacatgacagcagtagtggacggagactcgggggaaggtaccgcacgctcgcgtgaattgccatcgcagatcacaatcccgtgcatacagggcgagatggtgtacctgcgaccggcttcggtgggcgacttggcatccatggacgcattggacgcctacgtgaacgcctccggtgtgacgggaaaggaccgcgtggcggaacgcgccgccgtgcaggcctgggtgcgccgttcacaggcgtgggtcgacggcatcgagtcccggaaatccggcatcggtgacccggaatcgcgccgcaccatcgcatgggcgatgctcaccgttcccgaggagcatgaggatgagaccgtcaacgagcacaccgccaccgagttcattggcatgatcttcctcatcgacatcgacggttgggcgcgctccgcccgcatccaggtgattctgggcaaggaataccgcggtcgcggctattctcgtgatgcgatgccgcgcgtgatgacatatggtttcgccgacgaacccgaaggccttggactccaccgcatctgggtggcggtgcccgagaagaacacccgttcctactcggtgtaccagtcgctggggttcgtgccgtccggcacctcgcgcgacgccttgtgggacgaggccaacaacaagtaccaggatctcaacgtgcttgacacgttggtcgacgagtacgacccggttcgtgccatggacgccttcggcatgcacgtgatcaccacgaatcccggcatggagaaggcgttgctgctccaccagcattccaccgcaatccgcaagcaggcactgtctgacaccatcgcctcgcagccggaggcacacagtgacgaggcgcaagacgagacaaccatgggcgacaagatgaagtccgactccgctcgcatcgcacaggacaacatcgagtcggagaatacgtggccgtacaacagtacggaacgcaacaaatcgaagaaggcatggtggcgccgactcggtcatgaccgcatgtcgtcgcgcaatgccaacgattctcaacaggaagagtaacttcaagcatgagtgccgaagatctcgacaactacgaaaccgatgccgagctcgcgctgtaccgcgagtaccgtgacgtgatcaagctgttcaagtacgtggtggagacggaacgacgcttctacttggcgaacaaggtcgatttcaacgtgcggtccgccggacaggacgtgtatttcgatgtgcagctctccgatgcgtgggtgtgggatgtataccgttccagtcgtttcgtgaagaacgtgcgcatcgtgacgttcaaggacgtcaacgtcgaagaggtgcagcagaccgacatcgacatacccgaagacatgcaatgacggccgttcgcgcactgcagcatgccattcgggcatgtgcggccgcgatgtccactcacaacggtatgagcgcatgcctaggtcatggcacgcactagactggtaacggctttacggtttgacttgaatgattcaggcagggcgttccccgatcgtccttgcaatatgcataccctcaatgaaggaggatctcatcgtgaccacgaacgaaccagaatcggtcgtcatcattggtggaggccctgccggtctcaccgcagcatgggagctggtgaaggacggttcgaacgcctatgatgtgacgctgctcgaggaatccgaggaattcggcggcatcgcccgtaccgtgaagcacgatggcaaccgcatggacatcggtggccaccgcttcttctcgaaggacgagcgcatcatggactggtggcaggagacgctgccgttgcagggggctccgtcatacgacgacaagaaactcggccgcgacacccatgatctggagcctggcggaccggaccctgagattgaagacaaagtgatgctcaagcgccatcgtgtctcgcgcatctactggaacaagcacttcctcgactacccaatctcgctgtcgctcgatacgctcaaggcgatgggcccgaagattaccatgaaggccggtttctcgtacctgaagtcgatggtgcacaaacttccggaagacaatctggagaacttctacatcaaccggttcgggcgcgtgctctattcgatgttcttcgaaggctacaccgagaaactgtgggggcgtcacccctcggtgatttcggcggattggggttcgcagcgcgtcaagggcctctcgatctccgaggtgctcaagaatgccgtgcagaagctgatgccgaagcagcgcgacaacagcgaggtggagacttcgctcatcgaggagttctggtaccccaagctcgggccggggcagctgtgggagacggtgaaagacaattgcgaggcccgtggggtcaaggtgaagaccgatgccaaggtggtcggtgtgaatcgtggtgccgacggccgaatcgcctcggtgctcgtgaggcattccgatggcacgcaggagaccctcgaggccgaccagttcatctcgtcgatgccggtgaaggacctggtcgaggccatggacaccgagcagcagcctgtgccgtccgacatgcgccatattgccgaaggcctgccataccgcgatttcgtcacggtcggcctgctggtcaagcatttgaagctcaagaacaccaccgacatcccgacgctgggcaatccgccgattgtaccggactgctggatttacgtgcaggacccgggctacaaggttggtcgcctgcagatcttcaataattggagcccatacctggtgaaggacgtggacgacacggtgtggatcggcctcgaatacttctgcgaggaaggcgatgagttctggaacatgagcgacgaagacgccacgaagttcgccattcacgaactcacccgcatgggcgtcatcgcaggcccggacgacgtgctcgactcgcaccgcgagcgtgtgaagaaggcatacccggcctacttcgacacctacgaccagatgcccgagctcgtggaataccttgattcgttcggtaatctgtactgtgtgggtcgcaacggacagcaccgctacaacaacatggaccattcgatggccacgtcgatggaggcggtggacaacattcgcacccacaagacctcgaagaacaacgtgtggtcggtgaacaccgacaagtcgtatcacgaatccaagtgatggttccataaaatacaagcagatacctgcgttcgcgtgtggcgcccatgttcacaacatgggcgccacacgcatttcgtctcgatattgaggtaccgtgtgtgtattcattcacacgaacccgtgtatgcggttcaatttctttttctgccatagcgcgctggtatgcgtatggcctagggaaggtacaacaacgtggccgatagccaagatttaagtaagatgaagctgcctgagctcaaggagatcgccaaggaacttggcttgcgcggtctttctgcgaagcgcaagggcgacttggtggcagcgatcgaagaggcccgcgccaagcagtcgtcggcgaagagcgaaacggcaccggcacaggcggaacagcccgcagggcacgatgatgcagtctccgttccggttcgcaagaccggtgcccgacgcgtggtgcgcaaggccggcgagccaaaggcagtcgaggagtctgctgccgaacagcctacccaggtgaaggaggagggccatgccgccctgcccgccgaagaggagatgacccagattcgcggtcgccgcgtgcgcgggaagcgccgtcagatggaatctgcggatcaggctgcgaccaatggtgagacgtccgccgccgagcagctgctgagcacgctgaatctgcccgagcacgcagagcgcggcggtgagcagccacgtcgccgtcgcggtgccgtggactcactgcccacgcggcggcgtgcaggagcggcggccgtgcgtgaaccggatgcggaagccaagccggatctagacgacattctctcgtcattgccgctgagtgcgaatgacgacgagagtgacgaacgtcacgaggagcatgcgcatcgccgtggcgagcgcggaagccgcaccaacgaccgttcaaatgcgcgtgccgacagggagaaccgccagcaccgcaggaaccgcaacgaacgtgactacgaggagcgtgaggagggcaacgaacgccgttcccgcgacgaacgtggcaataatcgcaatgagcgcaacaatcgcaacgaccgcaatgagcgtcgcgaggagaacaccgaggatctcgtggaggtcggcggcatcgtcgacgtgctcgattcctacgcgttcattcgcacttccgggtacctgcccggaccgaacgacatctatgtgtcgatggggcagatcaagaagtacggcctgcgcaaaggcgatgccgtgcgcggttacacgcgtgcgccccatgagggcgagcgccgcaaccagcgtcagaagttcatgccgttgcagtcgatcacgctcatcaacggcctaagcgtggaagaggcacaggatcgcccgaacttcagcaagctcacgccgttgtaccccgacgagcgcctgcgtatggagaccacgccgaaccgcatcatcggccgcctgatcgacatcgtttcgccgatcggcaagggccagcgcggcctgatcgtctctccgccgaaagctggcaagacgatcacgctgcagaacatcgccaatgcgatcgctgtgaacaatcccgaggtgcacctcatggtcgtgctcgtcgatgaacgcccggaagaggtcaccgacatggagcgcaccgtgaagggtgagatcatctcgtccaccttcgaccgcccggcctccgaccataccatcgtcgccgagctcgccatcgaacgcgccaagcgcctggtggagctggggcaggacgtggtggtgctgctcgattccatgacgcgcctcgcccgtgcctacaacatcgcggcacctgcctcagggcgcatcctctccggtggtgtggacgcccaggcactctacccgccgaagaagttcttcggtgccgcccgcaacatcgaaaacggcggttcgctcaccatcatctcgtcggccctggtggagaccggttcgaagatggacgaggtgatcttcgaggagttcaagggcaccggcaacatggagctgcgtctgagtcgcgaactggccgacaagcgcctgttcccggctgtggacatcaatgcttccggcacccgccgtgaggagctcatcacgaacccgcaggaacttccggtgttgtacagcctgcgtcgcctgcttggcggcctggagcccgagcaggcctatcagacgctcgtgccgcgcctgaagaagacgatgacgaatgcagacttcttcaaagcgatcgtgcaacagggcaacagctcgctgaacggcggctcgaacaactgacggcatagccccgttcatatacgcgattggcctccgacgtgcccagaagggtcgtcggaggccaatcgcgttgtgctcaagaatcgactcacagtgtggggcgcacgagcagcagacgcagattcggccagtggtccgcagtgtcgtgcgccaactgcgatgccaggccgcccgatggcccgctcattgcggctcccgcctcaagcaacggctgcgcttgcccgatgatcacggtctcgtcaacgacctgcgaggggtcggcatgcagcacgaggccgctggcaagatcggagacgccgaactgcgtggccaagcgctcgctttcgggaacgcgctcgcgatgcggggtgccgctgccaccggcatcactgctgtgatgcgcggcatcgtccttcgctccgccgcccttcacaccgagtccagcggctgcagagccggcgaatttgctcacgtcagcggcggcatcgtcatcggacgccacgacgagcgacgctcccgcctgagcgtcgtcgccttgctggcgacgttccttggcctgcgcatcggcaatcgccttggtgcgcgccccgacgatcttcccgccgatcgaatgttcgagccagccgtcgtacacctgcgatgcgattgcggagactggcgtgcccaagccagcgttctgcgcggccccagaggcgttggcagctgcatttgagaaacggtcggcgtaccgcaaggcaatctgccggtcggcgctcgaggcaccggtgcgctcgcgcgcctgtgccagctcgttcatcgccgcatccaccttggtctggtcgctggtgagcgtgctgttcgaaccgaactgcgcgtctgtctgcgcaatggcctgcgcacccatagcctgcgcgcgcgagacatcgccgccggtcagtgcattgagattctccgtatacgcatccgtatacgccatcgaatacggaatcatcgcgctcgacagctgtttctgccccgccgcgtagttctgcgcgccatcgcgggagttcatgccggcacgctgggagagctcggccgtcagcccctgcgtgccgcgttgtctgatgcgccggatgatccagtcgacctcgtctgccgcaccggtgtgctggtaggcgtcactgcgcgcattgaccgcgctcgccagattcgtgaccgcccgcgccaggggtgtgtctccgttcagctcgcccgcggtgcccatgagcgccgtcaactgggtggaattgcccacagaaccgctcagatgcgcggtatatgagctgacgtatgccgccatgtattcgtggaatgcgcgtttgtgcgcggcatcggcctgcgcgatctgctgctgtgccagcacgcgttcctgctcgcgcaatcgttcgagttcgccgatgagtctcgcattcgcatcgtcgttgttctcgccggtgatcgaattgaccaaggtggtcgaattccgagccaatgactgcagctgcgcagtgtagccggtcggcgcggattgcgggagcacggcgagcgccaccgggctcatcgagaaacgtttggcgtcggcatacacgtggaagtcaagcgtagaacccggctccgcggtcgcggcgatggtgatggccgaaccgtcgcgttgcacgaccacgccgtcggaggccgagatgtcgcccactgccgcactcggtatggagaggaaggcgaacgggcgcatctggcgaccgagccgctgcatgccgtcgccggcccggtcgttcactcgtgccacgacgtgcacgcccaccatgccacttgcgttgttcagtctgtcgaccggcacattcggcccgttgagcgtgtagctgacgtcgagggtgaacggcagcgagccgtcgagctgcatatgcgacgtcccgttccgcgacaccgcgtacatgcggcgtgacgaatccgcggcgctgttcaccatgaacagatcgtcgtcggtgaaccgggccgccagaccctccacattcgttgtggcgggctggtctgcatgcgtgctcgtgagcgcgggcatggtgagcgcggcgcacaatgcggctgcgagtccagcagtgagcacggccttggctgcagatggtttggcgtggtgtggtgatgatgagtgtttcacggcggtgttgtggtggggaagtatcaggcgaagatgtcgagcacgcccggatcctcgccggtttcggcgatgcgcttatgccgtttcttggcttcggtgaccacgaattcgcggtattcctcggcaatctctgggtcgagtcccgcgtcgattgcgagtcggcgcagacggcgcatctgctcttcctcgcgtttgtagtcggcgggtgcgaatcctgcgcgtgccttgagcacacccactgaagaggtgtatttgaagcgttccgcgagcaatgcgacgattgccatgtccacgttgtcgattgactgtcgcagggtctctattttgtccacgatgtctcgcgtgcgttcgtcgcgccagtcctgctcggaatcgatcaccgtctcattggagccggaggcgccttgttccatatgctcttcgctcatatctctacagtagcgtgctgtgactaccgaacgagagcatatgggaccggggcagtcagcgcgggaaatagcggtgcaacaccatcgtcgtctccacgttcgacggcacgatgcggtggatcttggtcacgaggtcctcaagctgcgggacggtgggcacggtgacggtaagcacatacacctgggagccggagacggcatcgcacgaatcgatgccgctgatgtgttcgagtttctccggaatgttcgcgttctcgtcgtattcgagtggcgtcaccgacacgaatgcgtggatggttccagtggtctgttccgggtaatggatgatcgcacggtagccgacgatgacgccgtttttctcgagcttctgcacacgcgactgtgtggccgagatggatagtgaagccgcctccgcaagctgtgccagtgtggcacggccattgtgttcgagaatgtcgagaataatattgtctttttcatcgagagtgcgcccatcaacataacggcgctctgtggtggtatgcgtgctagtcatggtctcgttcttttccaacagatagaaaatacgttcatcaatgagtttaagaccccgacaacttttttgtattcgcccaaagcctatacgcgagacgaacaacctgcccattaatttccgacgaataggagatggtcccttgcatgccgccgccggaaaacgaaatgcgggaggcacatgctcatgccttcccgcatttcgtttcccggattcgcgcttactgcgcggccttcggtttcttgaccggtggctcgccgagctcgctttcgaccacggtgatctcctcgacgtccgtctcgtccgatgccgggcccggtgctgccgtgccctcgcccttcggacgggcgaacttcgccatgaggtcgctggccttctgcagtgagatgcggccggtgacgcgtgccgcctcggcgatgtcgccaagggccggcgccagggcgtcgtgcagctcgtcgttcacgttgagcatcaccgagaggatcggcgtcttcatcgagaccttggccttcgacttgatgccacgcagtgcggtgagtgcggctccggcctgcgtgagcagctccggcgaggccttgaacgcggcggtggcgtaagtgatgggcttcggccatggcgcatggtgcacggagccttcgccggcgtgcatccagctccacacctcttcagtggtgtagggcaggaacggtgccaacaggcgtgcgaatgcgtcgagtccgagtccgagcgtggtgcgtgcggacttcacggcctgcgggctgggctcaactcctgtggattcggcggtgccataggcgcggttcttcacgagttcgatatagtcgtcgcagaactgccagaagaagtcctcaatcgtctccagcgcctttgaatgctcgtagttgttgagcgattcggtcgcatcgtagaccaccttcgccatcttcgccatcgcggcgcggtcgagcggctcggtgacgtccttcggatcccagctggccgtggcgccctcgcccacgtggtggttctcgtcctcacgaccgatcgccaaggcgaacttcgtggcattgagcagcttgatggccaggcggcggccgatcttcatctgcccttcgtcatacgtggcgtcgaggccgaggcgcgccgatgccgcccagtagcgcacggcgtccgcgccgaactgctcgatcggcttgttcggcaccacgacgttgcccttggatttcgacatcttcttgtggtccgggtcgagaatccagccggacagcgtggcgttggcccacggcaggcaatggttctcgaggtcggcgcggtcgatcgtgctgaacagccaggtgcgaatgatgtcctggccctgcgggcgcaaatccatcgggaacgtggacttgaagaaccgctcgttctcctcgccgggctcggcccacttcgtcacgatctgcggggtgagcgacgacgtggcccaggtgtccatgatgtcgggttcggccatgaagccgttcggctggtcacgctggtcctcgccgtacccctccggcacatcgatggtcgggtcgatcggcagacgatcctcgctcggggtgagcgggttgctgtaatccggttccccgttggcgtcgagcgggtaccacagcgggaacggcacgccgaagaagcgctggcgcgagatgagccagtcgccgttgaggccatgcacccagttttcgtagcgcacgcgcatgaagtcggggtggaagttgagctccttgccgcgctcgatgagctcggtgttgagggccttgttggtgccgccgttctcgaggtaccactggcgggatgtgacgatctcgagcggcttgtcgcccttctcgtagaagttcgtcatacgcatggtcggcttcggttcgccgtccatgtcgccggtctcctgcaggtcctccacgatctgcttgcgggccgagaacgtggtcttgcctgcaagacccgcgaaatactggcggcccttctcgtcatggatccagtccggggtgtccatgacaatgcggccgttgcgctgaatgatcgagcgggtcggcaggtgcaggtcacgccaccattcgacgtcggtcatgtcgccgaacgtacagcacatggcgatgccggcgcccttgtctttctcggcggccgggtgggcgagcacgggaaccttcacgttgaacagcggagaggtgaccatcttgccgaaatacggcttgtaccgctcgtcatccgggtgcgcgatgagcgccacgcaggccggcagcagctcgggacgggtggtctcgatgtagatcggctcgccggtctcctcgaagcggaacgcaatgcgatggtagaagcccgggtattcgcgcgattcgagctcggcctgggccacggcggtctggaacgtgacgtcccacaggcccggggcatccttctggtaggcctcaccgcgttccagattgcgcaggaatgccttctgggccacgcgctgcgggtactcgccaatggtgtgataggtctgtttccaatcgatcgacaggcccagctgacgccagagttcctcgaactgcttctcatcctgcgcagtgagcttctcgcacagttcaatgaaattcttgcgcgagatcggcacctggtccttggcctggatcttcttgccctcggtgccctcgaacggcggcacgaaatccgggtcgtacttgagcgaagtgtcgacgcgcacaccgtagtagttctgcacacggcgctcggtgggcaggccgttgtcgtcccaacccatcgggtagagcacctcatagccgttcatgcgcttgaaccgggcgatgatgtcggtgtgcgtgtacgagaacacgtgaccgacgtgcaggtgccccgagacggtgggtggcggggtgtcgatggaatagacggccttgcgctcgcctggatcgtggaacgtgtacgtgccatcctcatcccagaccttgcgccacttggcttcaaggccgtccacgcccacacggtcggggagtgcggtgagattggcgttgatcgaataatcttcgctatctgtcatagaaagaagtctaaaaagctacgctgacaacatatgcgtttccgccgccgttccgcggccgcgctagctcagctgggcgagcgcaagtctggagcccgccagattcgcgtccacaccctgcacgtcgttctgcgcggccacataatccttgcccgtgtacagccacgcgctcgcggcatcatcgctcaccaggcggtcgaattcgcgcaactgttcgcggtagtccttgaaatcggtttgttcgagcgccttgcggtactgctgctgcacggttccgttcacatagccgaacattgcgctgccgtcgacgaaccgcgtgtaatcgtgcggatcgtccatctcgatcagcgcgcaggtgtagtcgccggactgcacgcgactgttcagcgtggccgaatcgaccacttccaacgaaaccggcatcggaatcgcggcgatctggtccaccagcgtctgggcgagctcgcggtgcgcctcatcggcgagcaaattgaacggtttgaagtaatctgcggcgaaataccagcgcatcgacgaagccttgccgaggtcatgctggaacagattgtcgaggtccacatagccgggctgcatctgcgagatcggcccgctcagctgggctttggcacccggctcggcattcgcgatctgccgtgcgtcaatggcatagcgtgtgaactggcgcacctgctcatcggagaatgggctctcgctcttgctgttgagcgccagcagagtcttgcgcgtgctgaaaccgtcttgcagtgtgatgccggacgtgtgggagagctgttcggcaatgtgggccgaacgggggagcgccacgttgagcttgccggctttgaggtcgtcggccatcttctgctcgtccgtgtaatagcgcagcgtcgcctgcgaggtcttcggcttgtctgcccaatagtgttcgttgcgggtgagctcgatggaacccggctgcaccgcgttcacgatgaacgggccggagccgtaggaatggtgtgcgaaatcggggttcttcgcattcgggttcacgatggcgccggcttggctcgccagtgcgggcaagaggcgcgggttcggcgaggagagcgtgaacgtgactgatcgcgcgtcgttgttctccacggccgtgatgttcgagagcccgtcgttcgtgtggtcgccggcgagcgtctgctggagcgagcgcaccaccgagctggcgtccagcggcgtgccatccgagaatgtgagcccgttgcgcaggaagaacgtgtagcgcagtccgtcggtggtctgcgtccagcgggcggccagtccggaagcgattgcctgctcgtcgttgaaggtgacaagcgtctcgtatacattgcccatgagtgcctgctgcaccgaacgttcgctgttggaccgaatgtcgagcgacgtgggctcgtcgaggagtcccacttcgagtttgcggccgccgcgcagcgacccaaccacggcgttgaggccgctgttgccgccgcgcagtccggtgatgcccacgccggccgccgcgccaagcacggcgatgatgacgaagaatacaatccaggggcgaatcttgcgtgcgcgcctgttgccgtgctcagtcatggctccagtatagataatccggcgcgcctctctgcccaccctgcgtacaaggagacaggtatccatgcaatctgtctccttttacgcagacaggtcattgcgcatcatcagttgcatcagctgcatcagctgcatcaacaacgcaaacatctgcgtaaaaagagacaaatcacgcacataaacgtccctttttacgggctcttctcaggttagtgtgtaagggccgtgcttcatcattgcttgtgtgatagaaaaattgaatgaggaaacacggcccttacacactaacctgagaagagcctttttacgcagattgaagattgcagattgggaattgagggtcgcagattggggggattggaggttgcaaatcgaagacccgctgcacggatagattaaacctcctgcgtaaaagggacggatttgcatgggtatctgtccccttttacgcagctggatccgcggtggattcgtgctggctttgcgtgctggctttgcgggctggattcgcgcgttggcttcgcacgctggagtcgtagctgtcttcgcgtgttgaattcgcgtgctggacacgcccggtcacttggcggttttgcgcgaacgcggcttcctgggggcgcgccgcgtggcgcgcgccttgcgctcggcggcgatttcgaggaactcgccggcgctcgggcaggtgggcagcagtgggcagttctcgcattcgggactgcggctcgtgcagatgttgcggccgaagatgatgagccggtgcgacaggtcggtccattcgctttcggggaagcagccggtgatctcctgctcgatgcgttcgggggtcgtgctcgtcttcatccagtcatcacgccaatgcaggcgcccggtcacacggatcacatgggtgtctacggggaatccgggaacgcggaacgcgttgccaagcacgacgttcgcggttttgcggcccacgccgggcagcgacgtgagctcctccattgtctgcggtatctgcccgccgaatcgttccacaatctgccgtgccacggcaatgatgtgctcggccttcacatggtagaagccaagcgggcgaataatgctctcgacgtcctccaagcgggcgtcggcgagcgccgcggcggtggggtaggtgccgaagagctccggcgtgatcgaattgacgcgcttgtcggtggtctgtgcgctcagaatcgtcgcgaccagcagctcaaagggcgtatggaaatccagctggcatttcaccgtcggaatgaactcgcacagggtctcatactgcctgtgcatgcgtgtgatgcgcgctttcctgctttcaccggccataccgctcccgcaatcctcgactgttaggttccatgcgaattcgcacgtccctaagggtagggtaaccggaagaggggaattattcgtccgccgaggtaggtgagcccatctcggcagcttcacgggcggtgttgttcgcagattcctcttcgggcgggtcgaagcggtagccgacgttgcgcacggtgccgatcagatgttcgtattcgccgccgagctttgcacgcaggcgccgcacatgcacgtcgacggtgcgcgtgccgccgtagtagtcataaccccaaacctcctgcagcagctgcgctcgcgtgaacacgcgaccggggtgctggacgaggtatttgagcagctcgaactccttgtatgccaagtcgatgggcacgccgcgcagattcgcggtgtagccgttcgtatccaccacaaggtcgccggagcggatgagtccgtcctcgtcctccgggccggaattcgccagtgcattcggcatcacgttatacgtggccacgcgttcggtgaccagacgcagacgcccttcgacctcggccggcgatgcggtgttcacgatcacgtcgctcaccccccattcgccgttgaccacggtgaagccgccctcggtgagaatgagcacgatcggcgtcgacagacccgaggcgtgcagcagcctgcacagtgttttcgcggaggccaggtcgtcgcgtgcgtcgagcagcagaatcgtgttctcgggcatgcgcaccagactcgaggcgtccataggcaatacgcgcacacggtgggagagcagggtgagcgacggcagcacggtggttggatccgtggaaaacgtcatcaaagtcaaatccgtcacgttcccgatcctctcctgttgggttccatgcttgtgtaacagcgatgtgcgcatggtgtgtgcaagcacgttttgctgtcagtgtagcggaagcgacgaaaaaaccctgcgaccatttcgcgatgagaaaccgaaaatgggacgtcgtgccggacgcgcgcccatcgcgacgggcgacgagtgcggctgctgggccgatttgtgggcgggaatggccccatattacactgtttcttggtgtgaccgcctgcgtggatgtatgcgtgtgacggtggagatatgaaggtgagagatgagtgagacacaacatggtaacgacgcccgcaatgccgcggcggacggcgaactgaccgcggattccaccctgaccgcgcagatggccccggattaccgccctgtggcgccggtggctccgttctcgcggtccgtatggttgcagattgcactctacgtggtgctcgtcgcgctcgcatgcattcccggcagcaatgccgtctcgtcggtcatgttctcgctgaccggctttgtagtgggtgtcatgatcatgctgtttgcgttcttcacgccgctgcgcgacggaattcccggccgtgtcaccggtgtgattctcggattgctcggcatgatcttcgcctccacgcccatgcttggcgagttcgtgttcggctcgatgggttcgccctcccgcccgcaattgggttcgccgggtacgttggcggtgtgcgcatggttcgccggcgtgggcgcgttgctcgtcgtgctcgtggtcgtcgcgttcggcaggcagatggctcgcctcgaccgcagccacttgattgtgcagttgtcgcatatggtgatggacggcgcatgcacggtgctgtgcagcggatggtgcttcctgccgatgctcatgcagggcttcggcgaaagcaaggcggagagcgcgaatggcgaattgtgggtgtggattgccggtgtggtggccattgtggtgttcgccgtcggtcttggattcatggatcgcgtatggtatcgcgattcgcggccgctcgagggcgcgcaggctccttgggtgggcttcgcgttgataccggtgatgctcaccggtggtctggtcgcgctcgccacgctggtcgtgcagctcacgctcacggtgtgagatcgcagacggccgcagacgcctgcagcatgtgaatggcgatgggggccggtccatatggaccggcccccatcgccattcacatgcgcgtctggatttcagagcgtgatgtcttcgttcttggacttggcgagacgctccttggcttccttgatttccttctcggcggtctcgacgtcggcgaagaagtccccgggcatgacctccttgcccggctcgagagccttgtactgctcgaagaagtgcttgatctccgccttgtggaacttggagacgtcgtcgatgttcttgatgttgtcataacggacgtcgtccggaacgcacagcaccttgtcgtcgccgccttcctcgtcgaccatgtggtacaggccgacggcgcggcacttgaccacgcagcccgggaacacagagtcggtgagcatcaccagcgcgtcgagcgggtcgccgtcttcgcccagcgtgccgtcgatatagccgtagtcatccgggtagcccatcgccgtgaacagcgtgcggtcgaggaacacgcggccggaggcctggtccacttcgtacttgttcttggaaccgcgtgggatctccacgacgacattgaaggtttctgccatggtatttctcctttgcatggacttgtgctaacgaacaacacaatacccgcacatgcacacgggggccgttcgtcgcgagttgcatgcggcgaacggcccccgtgtgctcagcggtgctctcagtcgagcggctgttccccggtctctacgtggaacacatgcgccacatccgcccagggtgccagcgagacgaagttgtcccagctccagtcgtactcacggccggtgagctggtccttcacgcggtacgggtgctcggtgggcagcccgagtgctttggcatcgacgtggatcgacgactgctgctcgttgtatgggtcgagattgaccacaacgatgagcgtgtcggtgcgtccgtctttggtgaagcggccttccgtctgccgtgcgaaggcgatgatgttctcgttggcggacggcaggatcgtcagattgtggtagctcgtggtggccgcatgcttcgagcggatctcgttgagcgaggtgagcagtttggagatgccgattctgttcgccgcggaccagtcgcggaccttgatctcgaacttctcgttcgacgactgctcctcggcatcggcgcgctgccggttctcgataagctcatagccgttgtagatgccccagctgggggagccgagggccgcgagcacggcgcggatggcgtgtgccgccacaccgccgtcgcgcacataggcggtgaggatgtcgggggtggtgggccagaacgtgttgtgctggtagtagccgcccttgccgttggtctcctgcaggaactcctcgagctgcggcttcgtgttgcgccacgggaaatagcagtgggactgcgtgaaaccggcgtagctcagcgcgcgcaccatggccgggcgcgtgaaggcctcggcgaggaacagcacctctgggtgcttcttcgtcacggctgcgatcacgtcctgccagaagcgcaccggcttggtgtgagggttgtcgacgcggaagatggttacgcccgcgtcgatccacaggttcatgatgcgttcgacctcacgctcgataccctcgagatcgttgtcgaagtcgatcggatagatgtcctggtatttcttcggcgggttctcggcgtaggcgatcgaaccgtccggcttggtgcggaaccagttcggatgctccttcacccacgggtggtccggtgagcactgcaaggcgaagtcgagcgccacttcgaggttcagctcgtgggcgcgctggcagaacgccttgaagtcatccatcgtgccgagcagtgggtcgacggtgtcgtgtccaccgagttcgctgccaatgccgaacggcgagcctgggtcgtccgggcccgcattgagggcaccgtcggggcccttgcggttcgtcacgccgatcgggaagatcggaggcaggtacacgatgttgaagccctccgccttggctcgttccagtccgctgacggccgtgtggaagttgccctgcacctttttgccgttgtcgtcgaggtaggcgccctcggaacgcgggaagaactggtaccaggcgctgaagctcgacttcgggcgttccacgtggaacacatggtcaccacttgaggtgagaccgtcgcgcagcggattcgtctcatgcagtgcctcgatgtcggcgttgtcggcgaaggtgagccggcttttggcgtcgagcgacgtgtccatcatcgatttcgctgcctcgcgcaacgtcttgcgctgctcggcgttgagattcgcgtcacgggtggaggcccagcgggtgagcagctcggatccgctggtcagggtgttctccacgtcggaaagtacatccaccttgatgcgggcgtcatgcaaccatgccccgtaggtgtcttcccaaccttcgatggccacgcgccagttgcccagctgcttcttcacctctgcgaattcggcatcccacgggttcagcgtggaatgctcgccagcctgcagcttcgccgtgtacaggtcgaggcctgcgttctccacggtcatcgggacccgtgccatgatgcggccgcgtggattcttcagcacggcggtcgctccgaccttcgtgcgcccctccatgaacacctgggcggaaacggtgaactgctccccgatctcgactcgggcagcgtagacgtcgtcttcgacggacggttggcagttcaggatgttgacgcgtccgaactggcccggctccttgatggcgatcggcatggccggtgcctcggctatgaatgtggcctgcttggacgcgcgtggcttgcgcgtgcgcgtcgttttcttcgccgccggtttcccggcggcctctgtctcattgtgttgtgcttccatacctgtcattgtatggagtttttcgcggctgaggttgcgagcctgtacaaacggtggaaattccttaccaatagtccacattgtggatgcatttccggtcggaaggccgcaggcctcttcgttcccgcatgaattcaatgcgggatggacaaagttcgtgccgttgtcgcataggcgttgtggattgtgaatagtggcgcggttatccacaatcgactgaaacgccgtcctccgtccacaatgccccgtccggctatgcacgccgacctgactgtgtgaatctgacagcacataatctgccaacacaatacgggaaggacggttggaatgaacagatcggcaagacatatgcgggtcgtggtggtgcggctgctcgccatgctggcggccgtatgcgcgattgtcggcatacggggtgcgactcgtgccaatgcgtacacaggggagaaactcaccgtggccagcgcctcagactaccaaagctacttcgatggcggccgaatctatttcttcggaatgatcggatatgacggccagcagagacggtactactgcatggatcaatcgcaggagacgaactacacgctcggcgtcaccaaaccgatgccggacacgttggtgacgcgcctggtgggcgagatgctcaaccgacaccaacgcgaacacaacgtcgacgatctgcaggcggcgttggcgttcatcgtgcacgatgcattcgacacaagccagggagatgccggttggccgcatgcgagagggattctcgaaagccaatacccgaacatactcgccaaggcgcgcgagctctatgaggaggtgcgtccggtcgtgccgcagtccattgcgacccgagtcgagtacaccgacggcaaacgcgcgggaaacatcgtgctcgagattctcgacgacgagggcacgcccaccacgaacacggagtattcggtgagtctggagggcgatgccgtgttcgcgaacggtgcgagaacgcgaatcgggcgcaccaacggcaagaccctccgcttcgcatggaaggcgagcggcgaaggagctgtgcgcgtccatgcgcagatgcaggtgccggcggtggagatggccgtgagctcccagaacctgttgcgcgtggctgcggccaagacggtggaagcggccgggacggcattcgacacggtcaccgtgttctcgccgacgttggtcacccagaccacgccgaaatccacagatcccgggtctgcggtgaccgatgacgtgaccatgcgactcgacggtgacgacaactactggcctgccgattccgcagtggaggcgagcgggtggtacttcaccggcctgcgcggggagaacttggactcggtcatacgcccggattccggcgaaccggcacgggaattcctaggcagactgaaacggctcggattcgaacccgccgcatacggcaacgcgacgttcacccatgacgggcagcataggcaggtgcaggccgtcagcgaggagaacgggacggagccgtaccgagcacatgacggcgacgcctacggcacatgggtgtgggcggtggaacggcaacggcaaccatccgccgtgcaacaggtgatgactcatgattgggtgagcgggttcatggagccggcggagaccaatgtgacccgcacgcctgtgcaggtgcggtcacaggccggtgaacacagtgcacacgtgggcgccatgctgaccgacgtgatcgaagtgagcggattcccccatgaccacggtgagttcggaggcaacgaacagtacgggctggctgccgacgaaccgtacgcccaggtaagcatgtggtgggcgggcgacggcaatggcggtgacgacgaaccgtaccggccgcaaggcgaggccgagccggaggaagacggacaccacacgctgatcggcagctgggacgtgcccgcgcgcaacggcatcgtgagattcggcggcggccagatcgatgcgcatggcgatgcggtcacggtgcaagccgcccgtcctgggtggtatgtgttcgtctggaaattcaagggtgacgcccgtgcgatgccgcagcagagcgcctacggcgacagctgggagtgcgtccgcgtggtacgtgggagcgtccatgccgaaccggctgcagacgggttgcccgcagacgagcgaaaaaccgctgacctcagtgcttccccgacgcaacagggagtgcgaacagaccccgccaagagcgtcacacggcagcccgcacctattcgactggcgagaacaggcgtgagcatgggcggcgtcgccctgatgggcgtagtgattgtgaccgccatcgccatgctactggtcgcgcatcgtcgacatgcgatgtcactgcgacgggaagacggtgaacacaacgcggcgaccgcaggcgccgacgaacacatggaaacaggaaaggaataggaggaatctcatgcgaaagcacaatggcgtgcgattggatggcgggcacagcgcgctcgcggtattggcgaggagggcggcttcggcctgcatggccgtggcaacagtggtcggtgtggtggaggcggcacccgcgtgggccgaagaatccgctgaattcccgcaaaccatgcatttcgccgtctccatggccaatatgaatttgagcgagaacgatctgccggcgttccgctacggtttctccgggttccgggaggcgaatccgaccgtgccggtgtacacgaacagtcaattcgaagaggcgcaggcgtacttccgaggcaatgccgcctattgcatggacgtcgacaaaggggctccgggcgaccattggggcgacgcgcggaatacggtgacggtggccgagccggtcacggggtaccacatgttcaaatacaccacccgtcccagcacggtggaataccacaaggcaggtgctccgcagaccggtgccgtggcgtggatcgcggcgaaggggtacccgaacgtggaaagtcagagcgtgttcgccaagaacctcgacgacgtcgacgcacgttccgtgacgcagctggcaatatggatcgcctccggtcaggtgcgtgtggaaggtggagaggactcatcgaaggccacgaaggcggtatcggtggcaaatccggggcatcaggtggctggggccggctattcgagcggcggccagcagaatttcgccccctacacgatgatcggtctggcgtggcttctggcgcagaaggccctcaatgccgaggatcgcgacgaatacgaggccgtgttctatgagccggtcggaaccgcaggcaccctgcaacgcatgctgtatgcgcgtagggtgccgaagaaagcgcacccgcggacggtgacgatgcgtaaggtcgcgacgaatgccgcatacaccaccgccaatgaggcatacgatatgaccggtgccgagtatgcattgcgccggaatgggacgctggtgcataccttcagcaccgatgccgaaggcagggcgacctcgagcgtcgatgtgatgcccggcacctatacgttgcaggaaatgcaggcgccacgaagaggctacatgctgaattccaaggtcaaaaccgtggagattgctgaaggatcaggcacgcagaccatcacgatggatggcgaacatgccgaattgccgctgacctccattgatgaccttcacgtgcgcaaagtcatagccaacgccggctcgccgggctccctcgaaggtgatgtggcgtcgttagagggggtgcgtttccgggtggagtggttcggcatggtggccaccgatgcagccgcccttgagggcaaacacccccaagcgaatgccatatggcgaaccgactccaatggcgttgcgcggttgcatgagaagccggatgagggcacatggccctacacggattcagcgggccgcaccatgtttcctctgggaaccgtgcgcatcaccgagctcaacgcacctcaagggctggtgcgtgccgcttcggcacaacacccgggcagtgtattcaccctcaccgacggcggcgaccacaaggtgatgcgcactacactgaacccgtggaacaacggctcgggcggcaacgacgcgaccacgatcgcattcccgaatgaaacggtcaaaggcggcgtcgaggtggtcaagaccgatgatgacctgcatggttcccagccacagggcgatgcgtcgctcgacggcacggtgtatgagatcgtcaacaaatccatggcgccggttcatgtgggcggcagggagattccccgcgatgccgtggtggcgaccatagccaccaagacggtgcaggggaacagtgtggctgcaacggagacgagactcctgccatacggcacctatcagattcgcgaacgcagtgctgcggccggttaccaccgggctgggttcgacaagaccttccggattcgcgaagacaacatgatcgtgcggtacacgctcgacgccaatggcgtcgacgcgaacatggccacgatccgcggagtgggtgcgaatgccaacgatgtgcagcgcggtgggctccaattgctcaaagtggatcgtgagacggggttggcgaccccattgggtgcggcttcgttgaacggcaccggtttcgaggtgatcaaccgcagtgccaatgcggttgtcgtgaacaatcgcacctataagtccggcgacgtggtgcgaacattgtctgcctcctacggagacatagtcgactccgatgggaagccaacggggagcaagggcatcgtggcgagaaccgccatagacgaattgccctacggaacctatgaggtgcgtgagaccgttgcctcggcagggtatttgcgcgatgcatccgcgcgcgcatggtcaaagcgcttcaccataggccatgatggaggtgatgcgtcaaccggagcctatgaggccaatggcaacccgcatcggtatgcctcattggcgcatgtatcgggtgcaggttccgcgtccaaccaagtgcagcgcgcggatttccacttcatcaagaaaagcgccgacaccatggagcgcatggggccgatcgcctggcgactcacctcgaagacgaccggggaaagccatgtgattgtttccgacaagaacggcgaactccatacgaaatcatgcgacggcaggttcaatgactccgggaccggcaccaccggatgtcgaccgcacagcaggaacacgaacgccaacgacccggacgctgtgaacgcaaacggggcggttggcaaggattctcaagggaatccggtggtgaaggatgcgtcgaaactcgatgccgaggccggcatatggttcaccggcatcgggccgagatcaggaggccagtcggtgcagtggacctccgcgacctcctatgaggtgacgcgcgatggtgcgaagcgtgctgtacaggtgaacgatgcattgcgcgcattgccctatgacgactatgaactcgtcgaactccccacacccggcgcgaacgacgggcatcgcatgctttcggtgaccctcaccgccaaggaattcagcaggaacggcgacggttcgttgaacccggacggcaacggcgtggacatggactacggaacactgggcaatgtggcgatgggcatgaccacacggcttgcatacttcggtgcaggtgccgatgcctttggcgatgacggcaatgccggtgacaagctcgcgcctgccatcggaacgctatcggtggtcgattcggctgaatactggggcgtgacggcaggaacgtacaccgattcgggcgagctctacgtgatcgagaacggcaggatttcaggcgaggctgtggcgaaggccacgaagcagttgaaggttggcaatccccatggcggcacttccaagctcactttcaccatcgaccatgccgaacgacttgccggcaagacggtagtggcgttccgcacgattcgcaatgccgacggcacgtcgttgctggagcaccgcgacgccgccgatgccgagcagcaactgcgcttcccgcagatccatacgaatgctgcggccgacatcgacgacgaagccaatgcgagcgcacaatccgtgacaatcactgacgcggtgtcctatgcgaatctcgttgccgggaagccctacacgctgaaggcaacgctccactaccgcacgttcggcgacacgggtgtggtgagtgacgggggagtggtgcacgaccgacacggcaaggaggtgaccgccgagctgccattcgcacctagccaatccgacggaacggttgacgtgaccttcctgttcgaaccgcccgaagaccttgccggcaagacggtagtggccttcgaaagcctgcagcataacggcgtggacttcgcggctcacgccgacatcgccgatgagcggcaggacgtgcgtttccctgccatcgcgacatcggcctcggatgcctttgacggtgactcgttgctgccgatcacgaatggcgtggtgaaggatgtggtggagtaccgcaacctcagtccagggcatgattacgagttggtttcgaccattcatgcgaaggtcgtgggtgatgacggcaccgtttccgacatgggcgcgctcaccgacggtgacgggaacacgctgacggtgacgacgacattcacccccgggcaggcggatggcaccgtcgatgtggagttcccgttggacgttgggcatctgcggttggaaggcaagcgatgcgtgatgttcgagaccctgctgcgcgaccatacgatgctcgccgagcacgccgacatcaacgacgagcatcaggaggtgcagatcgcgagcataggcacgcagttgacgaccgagggcggcgcccacgaattgcaggtgacttcggcggtctcgcaggcgcaactggacgcacagctgggaatacaggtgcgcgaaagcgacgatgacgtatcacaggtggaagtggtgctcaccgacacagtggcctatgccaatctgctggcagatatgccgtatcggatggatggcgaactgcatttgcgcggtttcgacaatgccggccatgcccgtgatgccggtgtgctcaaagaccatgccggcaatacggtggtcgcctctgtcgaattcacgccgaaacggtccaacggcacggcgaggctcgaattcagattcaccgtgctgaaacgggatctgcacaatgttgtgttggtcgcctacgagcgactgtactccaatccgatgcaggacgcgcaacagctgacggccgagcatgccgacatagcagatgagggccagaccgtgcgcatcatcgatatcggcacgcaggcccgcgacgcccggtctggtacgcattccggaacgctggactcccgaatctcacaggtggatacggtcgccttcaccggattgaccgtaggcaaagaatatgaggtgcggggagaactgcacatacgagatgccaatggcgaggatggcggtgtgctcaggaacaaggacggccagccggtgactgcattcgccagattcactgcagccaagccaactgggaccgccgagttgaggtttgacgccgaactcggcaacgtgtcaggcgaagtgcagactgtggcattcgaacggctgatggttgagggcaaacaggtggccatgcatgccgacatcgacgatgcggggcagacggtgatctatcccaagccgccggaaccgcagagaccgcggggcaacgcaggttcgggcacgtcggtcgcggcgacaggtgtcatagccgacgtgttccttgcctttgccgtcatcactggcgcgcttggcctcatggtgctcaccggattgctcatagcacgcaggaaccggaatctgtaggtaggctcgttgaatgacaccctttgtggagtcgacggaatgcgtgagtcgcggagtccattcggcgcgggcaccggttggcgttcggtgcgccgggctgaattcgcgaactgcgcattccgttgtgcgcgcgtcgggcgcctgcaaaaatggagacgaatcaggcgcagcacagagcagaacggaggggcgcaggcatgaccagcgagcaatcgccccacaatggcaatgcggccggacctcctgagcccttgacgcaggagggaaacggcctgtcgggacgcgtgaagggcagtgcggcacggttcgattggcgggaatcattcaagcatttgctgttcgccgtggtgtgtggcgtggccggaggtttcgggtcgattctgctctgcctgttcgtcgatgccatgcgtagtgtcttcgtgcgcaacacctggctgatctggctgctgccggtggccggattgctcgagttgctcctctacaagatgttccgcatcccgctgggggagaccaccgaatcggtgattgcgcgcatgaggcacggtcggacggtgcgaggattgctggcgccgggcatctttctcaccactggcatgtcgattctggctggcggctccgttggcaaggaggctggagcgcttcagatgggcgcgagtctgggagccaccattgccaaaccgtttaagttgcacgatgtgctgcgggttcaggaaggcgcagccgaggaccgtagtatgcactcctatgccgcttccatgggcatggccgccaccttctcggcattgttctttgctccgctcggttcctgcatgctggtattggagttcatgcgcttcagcgagctgaggtatgtggcgtcgatgctcatcggttgcttcgtcgcctacttcattgcacgccatttcggcatcggcgatctgatttgcacggtgccgattcccgaattcacctggcgtgccgtgggcatctgccttgtcataggtgtcgcctgtgcggtggccggctccatcttcgcgctgtgcatccgcctgctacagaacacgacgatgcagattgtgcgcaactattatctgtgggtggttgtcggtggtctgatcatggccacgttggtctccgtgttcgggtggtggaggctcaccggttcgggcggcgaaatgctcaaccacatgcttgcacagcccaatgtgtcgtgggatttcgcaatcaaggggttgctcaccttcatctgcctcggtttctggttcaaaggcggtgagatcatgccgtcgttgtgcataggtggcctcctgggaggcgcgtgtttcgccatgaccggctcgagcccgcagatgggtgtggcggttggcgctttgtgtttcctagcagcattcaaccgctgcccggtgagcgcgtttctgttgggatgtgagatctttgggtggggcatggcaccatttctggccgtgggtgtggcggtttcgttcatgttcggctatccggcgggcatgtatggggcgagcatcgatctgctcatgacctccggctggcgcaagttcgtattgcgacagcataggcgtgccatggagaatgccgccaatcacgatcccgatctgttcgattatgtgctgagcgccaccaccgcgttcaagaaggccaccgatcgcacacgggtgttcgccgatccttggatcgccgaacatcagcgcgaacatgaggaacacatgcaggagcgtatggaacgtgaggagaagcggcgtgcggatgtgcgcagggcgcagcgcgcgcctgcgaagccgcatcatcctgaggcaccgacgcgccctgcgcagtctgcaaatgcaaacggtacgcaagagcgggagccgaagacgaagtagtcggttcgagttccgtgtgtgccatacgttgtctgcaggtttgtcaataggcaattcacggacgtctgtcagatgtgatccgagcaattgccgcgacaagcgtaaagctcgaataaatgtacgctgagcgcttttctgccgagacggcacgaaaagtcgtcttagtatcgaggtgaataaccataccaggaggatgtttgcaatggttgatgtaagtgtaactgctacaagctcagaccagaatctcacggattctccccactacctcgccgagacgctcatcaagaacggtgtcaagcatatgtacggcgtcgtcggaatcccggtcactgatttcgcacgtatcgcacagggcatgggcatccgcttcatcggcatgcgccataggaggacgcggtgaacgctgccgctgccgaaggattcctcaccggtcgcccagctgtggcgctcaccgtttccgcgccgggcttcctcaatggtctggcaccgctgcttgaagccaccacgaacggcttcccggtcatcatgatcggcggttcgtccactcgccatgtcgtcgacatgcacgaaggcgaatacgaaggcctcgaccaaatgaactatgcgaagcagttctgcaaggaatcgttccgcatcgacaagatcgaagacattccgcttgctgtggcccgcgccatgcacatcgcatgctccggccgtccgggcggtgtctacatcgatttcccggacgacgccgtcgcccagacgctcgacaaggatgtcgccgagtcgcagctgtgggtcgcgaaccagccggctccggcaatgccgccggcgcagtcctctgtggatgaagcgctcaagctgctctccgaggccaagaaccctctcatgcttgtgggcaagggtgcggcgctggcccaggccgaggacgaactgcgtgaattcgtcgagaagaccgacatgccattccagccgatgtcgatggccaagggcgtcattccggacgatgacccacactgcacggcgagctgccgcggtctcgcgctgcgcaccgccgacgtcgtgctgctcgtcggcgctcgtctgaactggatgctcaatttcggcgagggcaaggaatggaacccgaacgtcaagttcatccagatcgatatcgacccgaacgagatcgagaacgcccgttccatcgcatgcccggtggtcggcgacatcaagtccgccatgcagatgatcaatgccggtctcgagaagacgccagtgaaggcgtccgcgcagtggctcgacatgctcaaggccgacgccgagaagaacgatgccaagttcgccgcccgcgtgaactcgaacaccgtgccgatgggtcactacgacgcgctcggcgccatcaagaaggtgtacgaccagcacaaggacatgatcctgaccaacgagggcgcgaacacgctcgacgattgccgcaacatcatcgacatctaccagccgcgccatcgtctcgactgcggcacgtggggcgttatgggctgcgcggtcggctattcaatcggcgccgcagtggccaccggcaagcctgtcctgtacgtcggcggtgattccggcttcggctttgacggcatggaagtcgaggtcgcctgccgctacaatctgccgatcaccttcgtcgtgctcaacaacggcggcatctaccgcggcgatttcgagaatctcggcgacgacggcgacccgtcgccgctgacgctgagctacgacgcccactacgagcgcatgatcgaggcgttcggcggcaacggctattacgcgaccaccccggcggaagtcgagcagatggtcggcgaggccgtcgcctccggcaagccgagcctcgtgcacgtgcagctcgccgattatgcgggcaaggagtccgggcacatctccaacctgaacccgaagcccgtcgtcggcccgctcgccacttccgaaatgaccgcgaacccctacctcaagggcgcccatatgtgattcgctccggtgccccggagcgccgcggcgtggtatgacgacaagtcatccgcgccgcggcaccggtgctcccgcccactccaccagaagacaagagaagacaaatgacaaagatattgatagacgacatcatccccatcatcgtcatcatggcgttgggctatgtctgtggaaaactcagctacttcgacaacgatcagcgtcagggcctcaacaagctcgtgctgaacatcgccctccctgccgcactgttcatctcgatcgtcaaggcgacccgtgagatgctcgcacaggatgcggtgctcacaattctcggcttcatcggcatcatcgtgatgttcatgttgagctactacctgtgccgactgatgttccaccattcgatccaggaagcggccgtatgcgcgttgatcgccggctcgccgaccatcggcttcctcggcttcgccgtgctcgacccgatctacggcgacaccgtgagcacgaacctcgtcatcgcgatcatctcgatcgtcgtcaacgccgtcacgattccgatcggcatgtatctgatcaacctcggccagagcaaggatcgcgagcgcctgtcgaaggccgccgtcacgaactcgaagggccaggtcagcatcgccaatccgaaggacgatatcgccgtcgatccgaacaaggatgcgaagaccgacaagacggcagaggtgatgatctccaagtcgtcgaacatgggcaagaagaagaaccagaacctcgaagcgctcatcaacgcactcaagcagcctgtgtgctgggctccgctgctcgccatcgtgctcgtgctcatcggcgtgcgcgtgccgtccggtttcgctcccaccttcgacctgattgccaaagcgaactccggtgtcgccgtgctggccgccggcctcgcgctctccactgtgaagttctcgctgggctgggagacgatctggaacacgttctaccgcttgattctcacccctgcggcattcctcggcgtcggcctgctgctgggcatgggcagcaatgtgaacaagctctccatgctcgtcatggctgtggccctgccgcctgcattctccggcatcatcatctcgagccgctacaacatctacgtcaaggaaggtgcgtcgaccaccgcggtctccacggttgcgttcgccgtcacctgcctgctgtggatctggctcgtgccgctgtgctgccactgattcagccctatatatatatataaatattcgggaccccgaccatgcatgtggccggggtcccttgcattggcccagattttcgcgccatcttctcctgcgtaattggagacatgtgcttcgcctgcgtaatttgggacatatagcggtctctatacgtctccttttacgcagggaagagttgcgcggcggtcgttagtcgttacctcctgcgtaattggggacatatggcggttcctatctgtctctttttacgcaggtttgaggagggaggaatggttgccaatctcctgcgtaatttgggacattctgtgcgctgtatttgtctctttttacgcagttgtagactgcagttgccagtctcctgttagcctcctgccagtctcttgcgtaattggggacatatggatcctttcatctgtctctttttacgcagagggtgcagaggtggcagaggtggcagaggatagctgaggatggcagatggtgcctgtcgctgcgtatttttgctggagatgcttaagcgctaaatctggaaaactgcagctgagctggaaatctaccatgagagatgatattttagagcgcttctccagtaatcggcaaatatgaaaccggtgcgatatcaatggaattcaaataatctgcagattatttgtcggcactgattgcgtattctgaacagtttgtctcacatttcgtagattaagcgtttcagcattcggcaactcggttgtgaagcgcttcagtttcacgatatctttacattcgtaatcggaacagctcaatggctgagcaaatgtgttccgattgcatgcaatgaagcaaacatctgcgatgaagcagtggaagaagaaagtaggctcatgcataccaacatgaagaaaacactggcagccgtggtcggcgcaatgacgttggcggcggtgcttccggcaacggcagcgcaggcggcggacaattcgctccacgtctcgggcggcaagatctactcggcgggcaagcagttcgttccgcagggcatcaaccacgcataccagtggtacccggagcacaccagctcgatcggggatatcgcgaacaccggtgcgaacaccgtgcgcgtggtgctctccggaggccgttacggcacgacgtcggcgagcgaggtgagcaatatcgtcaacgagtgcaagtcgaacaatctggtctgcattctcgaggatcacgacaccaccggctacggcgacaccgcgtatgccgccgatgccaagagcctgagcgatgccgtgcagttctggaagtccgttggcagcgcagtgaagggccaggaagattatgtgatgatcaacctcggcaacgaaccctacggcaacaacaccgcttcacagtggacgcaggggaccaaggacgccattcgccagatgcgcgacgccggtttcaggcacacactcgtgctcactgcgccgaactggggccaggattggcagggtgtgatgaaagacaacgccaagagtgtgtacagtcaggattcgaacgtgctgttcgatgtgcatatgtacggcgtgtacagcacggcggacaaggtgaagtcgtacatcgactccttcgtgaaccagggtctgccgctcatggtgggcgaattcggcaacaagcactccgacggcattccggatgccgcgacgatcatgagctacaccaaggaaaagggcgtgggcatgctcgcctggtcgtggtgcggcaacaccgagggcgtcgagtacctcgatctcgtgaacaactggaacgccggctcgctttccggctggggcaacatgttcgtcaatggtgccaacgggttgaagagccgcggcatagagaaggccggcatctatggcggcggctccaattccggtggctcgggtaacactggcggcaattccggcacgaccgatgatgggtacccgatctgctcctctgcttccgtggacccggacggtgacggttggggctgggagaacaatgcgagctgcaaggttcgctgaaaggggcgcatattacacaatgagaacactgcgacaatctaattcctagaatctcctactcatatgaagccggccggttccactgttcggggaaccggccggcttcatatgcaatatgcgaagggcgggtttcgataccgcattgatatcgaaacccgcccttcgcgtagcaggctatgaccgcgtgtgagcggtgcagcgcaatcaggcctgtgccggagcggcggtgaggtctgccttgacgccatcgttcgagccgatgacgcccttggtcgccagatcggcgatctgctcgtcggtgtagccgagggacttgagaatctcctcgttgttctcgccgagcttcggcgcgcgctggtaatccggcgcatagttgctcatcgtgaacggcaggccgatcgtcttgaacttgccgcgggcgtcgccctgatcgatcgtgatcagcgtgccatcctcgttgagatccggatcgttttcgagttcgttccaatcgagcaccgggcccaccggaacgcccttggcgccgagttccttggtgagcgtgtacttgtcgtactgcatcgtgtattcctcgacgcgcttgtacacttcctgcttgtgctcatcgcgagcgttcggcgtgctgaacttcggatcggtgagccaatcctggaagcccatggcgttgcagaagttctcgaatcccttctgcgactgctgaatcacaatgtacacataggcgttcggatcggtctcccagcccttggcgcgatagcaccagccgagcacgagaccgccctcggcattggccgcacgcggaatcgctttgccgaacttgtagcccgggtagcagtcgtagtaggaaagctggtgtaggtgatcgagaatgagctgatcacgcagcttgatgcggcataggttgagcactgcattctgcatggactggtacacgaacacgccttcgccggtgcgctcgcgctgcagcagtgcggtgaggattgcaatcgtcaggtgcataccggtgttcgaatcaccaagggcagcgccggactgcgtcgggatgttcttgtcgccttcccaccagccggtggtcgaagcagcgccgcctgcgcactgggcgacaggctcgaaggccttgacatgttcgaagcggctgccctggttgaatcccttgagcgaggccatgatgagcttcgggttgatcttgtggacctcgtcccaaccgaagccgagcttttccacgtcgcctgggccgatgttctctacgaacacgtctgcgtccttgagcaggtcggtgaggatcttcttgccttccgggtccttcatgtcgagcgtgatcgacttcttgttggcgttgagctgcaggaagtacagcgagtacgagccgtcgacgtcgttcatctcgttacgggtcgggtcgccgccatgcaccttctcgagcttgatgacctcggcgcccagccatgcgagaatctgggtgcacgaagggccagactgaacctgcgtccagtcgattaccttgatgcctgccagtggggcagtgcttttgtcagccatacatgacctccttgtaatcagttgtaatcaatatatgcacgaaacgtcgttattgagacttgtttcagctactaggggcaagttccagcccgtggaggaggtgccttttccgagatcggttttcggtgtatgggtcgctttcgctccgtgtgcccggtcctgtgtttcccgtatcttgttggccatcgaggcagtatattcacaaaatggccgccgtaagtgctcgctcattggttatatttcgctggcgctcccaatctggccaatggaacggggagtgtggacggtgacgtagattcgattggtgcgcggagtcggtttcatgcgctggaaaagcaaaagggctaggaattcgattcctagccctcagtggtagcggggcatggatttgaaccatggacctctgggttatgagcccacgtttctacagtttatccgagtttggtattgtttattctaggtcttgacaatgacctagaaacgccgtaattcattgatttctgttaatggtgattggtgactttgtccaacttttgtccaactgcatccatgtccagaattgtccagaaatgatacactggatacatacgaaggaggtcaaagatggcgaagcgagagacatcgggagagatcaaagagttggagcgcggtcggcggtattcgattcgtgtgcgacttgcaccggacgatactcaccaatcgtggcactggtcaaagagtcgcaaggttcagggaaacaaggcagaagccacagcagctctcgtggcttacaggcaggagctagaagatgctcgtagtgggaagagcgttactgtcggagagtatgcaaccgatttccaagctaagaggagggctctcggaaaggtgtcttcgctgactatcgaacgagatcagcacgagattgatcgcatcgtgaagtttctcggtgatgttcgcgtagtggatctagatgcacagcgtatagagaaagcatacttgcacatggcagagcaagacaacgcatcgcctgacgcgattcataaggtgcatatgaagttggcgcagatcatgcgcaaagcctacctcgaggaactgattgagcgtaatccatgcgatgccgtagaggatatcaaacgtccaaaggtaagtccgcagaaacgcaaagaaacgcgaattacaaaagaacaggccttggagttcgtgcacaagcttaagaatgagccgcaagacggtcggattgtggcagtctggcttggtctggcaactggcttaaggcgcggcgaagcgctggcgcttgtctgggaggatgttgatttagagaacgcacgtctccggattcgtaaacagtacggcaaggagaaagtacttaaagacccgaagacagcaaagtctcgccgcacgatttctattgataaccagactgtagaattccttacgaagtggaagaccaagcaagcagggctatttgcagaagtggggcttactttgcaggaatcctcgccagtatgcagtaatgatctgtgcgttttcctcgatcctgacaacttcagcagatggaggaggaaattctatgttgaagagggactggcacattacgcgcacgaatcaacctatatcgatcgtcgcggaatagaacgagtgaagcggtcgggatacatcggcccgaactttcaggcattgcgaagagctcaagccacgctgctggtggcggggggagtggatcccaagactgtgcaggcgcgcttggggcacgagagcttgaacacaacgctgaatatctatgccgaagaagtgggcgagaatgatcgtaaggctgccgattttatgggcaagctgttggaatagtgggttatcggtagtgctgaagatctagggtgtatataattaatcgatcagaatgaatggatggtggtgatacaggcatggctacgcctctcaatcgagcaaatcaggcgaaagaagacgagttctacactcagttgtcagacatcgaatctgagttgaaacattatcggaagcattttgcgggcaagacggtgttgtgcaattgtgatgatccattcgaatctaatttcttcaaatatttctgcttaaatttcaatcgtctgaagttgaagaagctcattgcaacttgctattcaggatccccgataacagggaacgagctcacgcttttcggtgacgacacagaagaggaaaggcgcacgccttacaaggctgttgtgacttctgtgcgtgatgccaatggtgatggtgctaccagcatggttgacgtggccgaattgttcaagcagggcgagaacctttgcgaacgtctagaaggcaacggcgatttcagatcagaagaatgcctgagattgctagatgaagcggacatcgtggtgaccaatccgcctttctcgaaattccgtgaattcgtgtctacccttgtggagcatgataagaaattcatcatcatcggtaaccaaaacgctatcacctataaggagttcttccccctattgcgggataacaaagtctggctgggctatggttgtggcgatatggcgtttaaggttccagatgactatgagccgcgtaaaacgcgatattggcaagatgagagcgggcagaagtggcgatccatgggaaatgcctgttggtacaccaatctcgacatcaagaagcgccatgaagacctagttctggttaagcgttacaatcgcgacgattacccaaagtatgacaattacgaagccatcaatgtcggtaaggtgattgatattccttgtgattatgagggaatcatgggtgtacccgtcacattcatggacaagttcaatccggatcagttcgagattatcgggctacttgctggcaatatccggggattagccggcattccgtcctctactggtaaggacggcccatacatcaacggcaagctgaaattcgggcggatacttgtccgcaacttgcaccccgaacctcgcccctatgaaacagtcactctcgaagaagcgcaaggaaagtaatgcagatcactgaaaaccgcatcaaggttcgcgacgtatatgaaaactatgagaacgatgatgaagagggtgtggtcggctatgacgatcgcttggatattcgtccccgctatcagcgtgaattcgtttacaaggacgcgaagcgtgatgccgtgattgataccgtattgcaggggctcccgctcaatgtgatgtattgggctaaaacaggcgatgacacgtatgaagttcttgatggccaacagcgcaccataagcctgatggaatacgtcgatggcaatttctcaatcaagtacgagaacaatgctatgaacttcgataaccttcccgaagacgttcaggagaggattcttgattacgaacttctcgtctacatctgtgatggcacggactctgagaaactcaagtggttcaagaccatcaacattgcaggagaacggctcactaatcaagagctccgcaatgctgtgtatgcagggccgtgggtatcggacgcaaaacgttatttttcgaagacaaactgcccagcggcccgttatgggaacagcaagggttgtaacggttacgtcaagggcgagagtatccgacaagagatccttgagacagcaatcgaatggatcgcagaccgtgacggcactacggtcgatggatacatgtcggcgcaccagaatgacccgactgctcaggagctgtggagttatttccgtacggtaatcgagtggacggaatcactcttccccgtatatcggcgagagatgaaagggcttccgtggggtctctggtataaccagtatcatgagcagaagtacgaccccaaggcacttgaagatcgagtgagtgagttgatggcagacgacgacgtaactcgaaagtctggcgtatacgagtacttgctgaccggccatgaacgcgtcctgaatattcgcgcattcaccgatcgagataggcgtgctgcctacgaaaagcaaaagggcatttgcccgttgtgccagcaacacttcgagctctccgagatgcaagcagatcacaatatcccatggagcaagggcggcaagacgattcttgaaaattgtgtgatgctctgtgtcaaggacaacatcaaaaagagcaacaagtaagcctcgtgctatgagtggcctaacgattgcgcttaggccacttcacgagaatgcctccatgctctgcgatgtgcgcgtttagagcgctctctgtcacgtagtccttgctgccgactcgaatcgagggaagcgcgtccatcattaggcgagccttattgcgtcctacatggaacatctgccgtagatcgttcacatcgtagaacttcagtcgatctgacggggtttcgctgctaggcacggtggccatggttcttcctcctctgcttcttggcgcttttttgcggttggttttttactcgacgatttttccgagatttgcgagcgctctgatcgagcttctttctctgcgcacgctgcttcgtctgctcagtggctttcttcctccgcagttcttcacgctgacgttccattaattcgtctttgaacttcgagttccgttctttgaactgccaatatgaccagatgacttcacggcaataggttgtcgctttggctgcgaccggtagtaacttcggtttcttgagctcgcagagcttgagcaactcaaagtagccatgcacctcccactcctcaatgagttccagaagttccataacttctggtcgttcctcatctgtgagcgcgattttcttccaatcggctccattgatctcaatcacatcttccggcagatactgaactttttcagggttatcgagatggaccaagtagcgagccattccgcgcggactttccactcgcagtatggttttcggcccattaaactgctcgaagaaacgtgtcgcattgcgacgtgtcgtcgtgttcgtccacattgcgacaacgtgcctatgtggtttcttcaacttcccagtcttaggatcctcgatgtccttgtcatggactggcgaaaccagtatctgcaaacccgacatttgcatggttgctttccagtcatcgggacagctgtcggggtagatcaagcccgcccaataccgacccttgtcgttcaggctggtttgcgtattatcgtcggtcatattctcgcctttctcgcatctcacatctcgtatgggggcagtcgtagtaggcccccatacacctttcaggcggcgactctgctgggtctgggctttcgctgacgcttcgcccatcgccagccgagtcaccgatgcagccggtgcagctcctcgtcactgatgaatggaacatgcagatagaccgtctgattagtctcggtatcccacaaatacccatcgccaggtcgagaaaaaggtatctgccatgggcgggctccacgcttcactgcatcttcacccaacgccatggtggcttcgcctttagagttcaatcgaagtgccacggtagtgagcaacaagctccgatatggcaagctggtgcttacccgcgggttctgggtagctaccacgaccgtgcagtttagagcgcgggatcgtgagagaatcgatcgcaccaactcgatgcacgagtctgatagctttttgttcgggcccgatcgaaccatgtccgccgcttcatcgatgacaagcagtcggtggcatgtctgggcgtcggtgagggagcgcgtcttgccgcgccattcggcggctagtgtgtccacattcgagttgaaatcagtcagcagatcatatgcttcttcgagggtgtaggctttacgggccagcacgttacagtagttctctgcttccatgcctgctttcagatcgatgaaccaaatttctccgccgaatgccacctcctgagagatgatgttggcgatgacgctacctttgccgctgttggactctccgatgacggcaagatgtgcagatcgcgggattgtgactgtcctcttcgggtcggcgatgtcaagaccgagagaatatcggtctgacggcagtttccgatggtttctgaagatattcatcgaagctcctctaatcgggcgaatgtgaccctgtattttgctcttgagaacagtccctgtgggattgtctccacgttcactgcttggaatgcgtggccgagacgtggggcaaccgcatctgcccatgcattcacgtcttcgtctgtagtgagtgcggcgggtagcaagaaaatcacgcgcttgggcttcctcgcgtacctcaccttcactgctttctcctcgtctggcgacaggctgagtggttttgcgcacagtgtgtcatgtttgcgggctgcacggctgttgtgacgtgcgatgaagaacgcgcacacagcgaggagggcgaagagaacgattgcaatgacgatgaagtggtcttgtgcgaacagttgcgctttggtgatgaaatccattggttctccttggactggttcgaatatgacaaatgtgaaaacagtgaagatggagtgccgaagctgaggttcgctccggcacttcgggacagccattgaggagaaatcagaacgtcatgtctgattcatcttgcagagcggctttgatagagcgcatttccagtggagttgggaagagacggccaacggagtcctctccaagaagaacttcgagacactcgtatggcttacccgccttgctcacaccctgcacgatttctacgtgcaaaatcgggtccgtggtgtttgccatgttgctcacctcctttcgttcgtgttcgtcggtgattccatctaaaaacatgcagttcggtttgacgaatttcgagtgcagaaattacacctgatgtggcttgagaccttgatatcattgggataacaaaatttgaaaaaagatacggccgaggtgagtatggagatcgatagcaaaatgttggtggcttcgctaaggaactatgcggaagcaaagcacatgcagctgcaagatgtaggtaagcagctgggattcagcaaagatagaaccaagagcatctttacaggacgatcaaagctcactggtgatgatgtgcttcggattctcatgaacgtggatataccattgccggagctgaagaggtacaggcaactttggcgtttgcgcagggaggttctgaatttcgaaaggccggacgactttgaacagtttgttgacggcctgaatgtgagtgcgactctctttccgaggaaagtgcaaggatcattggcaaggagcgacaacgaacgagtgtccactgaattggctagagacatgatggcacgtgaaaactggtatgtgcttcgaaatggttgggtctgtgcgctcaaagttgagggtaagtgggtgacttttacaccattcgcaccagatttcatgacagcggcaagggcaatgatcgggcttaaatggattcaccgaaagactgaaacgagtatcccgttcatcgattggggtgctgttcgtggaggatgcccctccagcgaagagacttctcggttcgtgggacgagagctgctgaagtatatccagagcaaacctgatcgtttccctctagatgacgaatttcggggcatggttgcggggaaagccatgggtgaattccagcagaatagaattctcgaactagaaaaaagcttgaacacggtaaaagagattgcagaaagctccttaaagtattcattgtctacggaaaaggatgaatacggtatcagtccggcggaaatctattccagtgttttcgattatctggagtcaaatgttacgaatctatatggaatccgtcgcctacttcttgaagacggcataaccataccgccgcagcttgaggaagaatgcgagagagtgcttgggttaaatgaacgacattacaaatattcgctgtacatcgagccaattcttgcggtaaatgatctaccggataggcttgcaagtcctactaaggcagagcgagtgcagtatgaaaagttacgtgcagatagcgaggaaaagagcaagaagagcaagagtggacgatagtatgtccagaatttgtccaaatccgcgttctagcgtagggcaagaagaaaataaaaagcctagaaaccgcacgatttctaggctttgattagtagcggggcatggatttgaaccatggacctctgggttatgagcccagcgagctaccgagctgctccaccccgcgtcggctgtttcaaacagcaaaagttaatattactcagacttgagggttagtcaagccggcgtgtcgccttaccactttcgggcgggttttacccacggattaccgccaatgcgtcatcggaatttcttctatgatatgggcatctgaacaaatgcatcgcatacgatccggtcgacgtcgaccggattcgtccaagtgctcgtgcaagggcgcaggagccccgcattcgcgtcagaaacaaatcccaggaaactggaggaggaagaacaatggtgaagaagatcattttggattgcgatcccgggcacgatgacgccgtggcgattctccttgccatcggcaacccgaacatcgagttgcttggcgtgaccaccgtcggcggcaaccagagcctcgaaaaagtcacatacaatgcgcgtgccgtgctcgagaaggcgcatgcgcccaacatccccgtgcatgcaggctgtgcgcgcccgatcatccgcgacccgcaggttgcggcgacaatccatggcgagaccggccttgacggcgtggaattgccggagccgacgcgtccgctcgatcccggccatgccgtcaactggatcatcgacacgatcatgagcaatgagcccggcaccatcacgctggttcccaccggcccgcttaccaacatagcgctggcggcgcgactcgaaccgcgcatcgtcgagcgtgtgaaggaagtcgtgctcatgggtggcggcgtgcatgtgggcaactggagcgccgtggcggagttcaacatcaaggtggaccccgatgccgcccacatcgtgttcaatgagaagtggccggtcaccatgatcggtctcgacctcacccatcaggccctgtgcaagccggagaagcagaggatgatcgagggcatcgggacgccgcttgcgagtttcgtttccggcctcatggacttcttccgcaaatcctatgccgaaaaccaggacttcgtcgatcctcctgtgcacgatccgtgcactgtggcgtacctcatcgacccgacggtgatcaccacacgccggtgcccggtggatgtggagctgcgcggcgaattgacgctcggcatgacggtggccgatctgcgtggccctgagccaagcgcggaggaatgccacacccaggtggcaatgaaactcgatttcgacaagttctggaatctggtgaccgatgccatccggcgcatagggtgagcgggccgcgcttcctgcacactcgagcatcctcgtttcacagtcgtgcgaccagagccgtgtgaccgcatatccgataactcaacgaatcattattcatagggagggtcgaaatgacctctgtgcacaatgcgcctgcaccgaagcaggtggatgccaaacatgtaggggcgctgatggccgcgttgatggccgccatcttcgcgttccagctcaacgcttccatgctttcacccgtattgacgacaatgcgtgtggaactcaacaccaccgacgccgagataggccttacgcaaacggtgttcttcaccgcctgcgccgtgttctcgctgttccttccccgactcggcgatctcaaagggcgcaagaaggtgctcatcggcatgctcgcctgcacggcgatcggctgcgtcatctctgcttgcgcgaccaatgtgacgatgttgatgatcggccgcgtgattcagggcgtagccggacctgtggtgccaatgaccttgctcatgctgcatgcagaggtcaccgacaatgcgcggtacgcgaggctcatggctatcctgacttcggtcaatggcggcatcgccggcgtggatgcgttgcttggcggctggcttgccggcaatttcggcttccgttcggtgttctgggtgatgtgtggcgtggccgtgctcgccgtcgtgctggtctggtcgttcgcccgtgagtcgactgccgatgagaccccaaagatggactggctcggcgcaatactcctttccgccgcattcctggccgcgtacctcgccatcaacgagatcgagaagctcgctggtgccaattggtggctcatcgccatcgagatcgttgtcgcggccgtcctgttcgtgatcttctggcatgtggaaaatgcacagaagaacccgatggtcacgacgacgtatctcaaggaacgccgcacttggggcctgttgctcaccaccttgctcaccatgaccggtgtgttcgccgtcatgaacggcattgttccggcgcttgcgcaagacacctcggtcggtgcgagcatgagcgccgacaccgtctcgctcgccacactcaccccgtatgcattggtgggtctggtgttcggcccggtcgccggtgtgatcgcctccaagatggggtaccgcagcacattgcgtggcggtctcatcgtctccgccatcgcgatggtgttcggtgtgttcgtttgccagtccccgcatatctggggattggtggtgctctccgtggtgcttggcctgagctatgccggcaccgcgaacatcatgctgaacggcctcggcatcgtgctgtcccccgaagacaatcccggttacctgcccggcctgaatgccggcgcattcaacctgggtgccggcttgagctatgcgattctctatggcgtgcagcagggcttctccgacgcgcatggtgccacgatggggtacaccggtgccatgatcgccggcatcattctgctggtgcttgcattcctgagttcgctgctcattccgaaaccagctcagaatgccgccgaggagcattgacgtagactcgtgcgatatggccggtgggtgctttgcgcctgccggccatattctttggattgcatatcggcatgcgtactgtgcggttgcgttgtaagaacgttcgcccataattggagcatgcctatcaagattcccggcggactgccggcccgcgccattctcgactcggagcgcatcttcgcgctcgagaagccggaggcggagcgtcagcgtgtgcgtccgctcaaaatggtgattctcaacctcatgccgaagaagatcgagacggagacgcagctgttgcgcctcatctcgaagtcgccgctgcaggtcgagatcgacttcatgaagacctccacgcatgagtcgaagcatgtgagcgcggaccacttagtgaagttctatgaaccgcttgaggcgtacgagggcaattgctacgacggtctgatcgtcacgggcgcccccgtcgagcatctgcggttcgaggacgtcgattattgggatgagttcaagcgcgtgctcgattggtcctccacgcatgtgttctccacgatgtacatgtgctggggcgccatggcggcgctctaccagcgctacggcgtgcacaagatggatctcgacgagaagctgttcggcgtgtttccgcaattcctgcaggatgagtattgcttcctcacgaacggcttcgatgagatcgcgctgcagccgcattctcgattggccggggtgaacgaggccgacatcgccgcgaatcctgaactgcaggtgctcacctgggggccgcaggccggtcccgggctgatcgccacgcgggatttttcggaggtcttcgcactcgggcactgggagtacggcaagtacacgctggcggaggaataccggcgcgatatggcgaagggcatgagcaatgtgccgttcccgcgcaactatttcccgaacgacgaccctgccttggccccactgttctcctggcgcgcgcatgcgaacctgttgtggcgcaactggctcaactgggtataccagacaaccccgtacgatctgtccgaggttccacagctgcgtgccgaacgcagactcggcaccgaccgttcgattcgacacgccccttgctcgccgcgcgatgatcagttcctgccgttcgacacgtcgggttacggcctcaaataaggcccgtcgtcccttgctgcccaccgccgaactggtgttggcacggcggtgtcggtgccgtgtcgttatgtccactatcgggctaataatcgctgttcagttgtccggcggcctgccgggcggctggcgagaactgttcgttgagcgtaagcaacggcgaccgtagcgtatgcgaagtaaggtatgcagtagattgccgtgagcgatgccgtggcgggtgtaacagacttgtcacaatcgccgcggcgccaaggcatagacttgcagcagagagacaatcaggaggcatgaatggttgatgtattcagcgcaggcgcactgacgcttgcagagtcatcgatggaaatgccgagcatcgacgacttcctcccaccggagattctgttccaggggacgccgttcgcaatcaaccgcatcatcttcgtgcgtatcctggccacgatcatcatgctgctggtgctgggaatcaccgctgcgcgcgccaaactggtgcctggccgctggcagggcgccgtcgaatggctcatcgagttcatcaagaaagacatcgtgtaccaggtgatgggtgaggtgcggggcaagcgctacgtacccatgatcaccaccgtgttcctcacgctgctggtgttcaatctgtgcggcgaggtccccggcatgaacatcgcggcaagcgccacgatcacgctgccgctcgtcttcgccatgtggtgcttcgcccagtattggattgcgggcattcgcgagaaggggctcggccacttcctgcgcgacgagctgttcccgaagggcgtgccgtggccgatctacatcctgctgtcgccgatccagctgctcgagctgctggtcatccgcccgttctcgctgacgatccgactgttcgcgaacatggtatcgggccatctcattcttgcgctgtgcctatcggccacgcagtacttcctcatcgacgtggtgaacaagttcatgatgcccttcggcgtcgtgaccttcgccgcaggcgtgttcatgtacctgttcgaagtgctggtcgcctgcctgcaggcatacatcttcgcgatcctcaccaccgcgtacatcaatatgagctacccggagatcgactgaccaccggcaaataactgttgctgaaaagcaatgaccagaaaggaaataacaatggatatcgttaccctcgctgaggttgccggcaacctgaacgtcgtcggctacggtcttgcagccattggtcctggcatcggtctgggcatcctgatcggtaagacgatcgagagcaccgcccgccagcctgaacttggcggtcgtctgcagaccctgatgttcctcggtttggcattcgtcgaggtcctcgcactcctcggcttcgtcgctgcattcatcttccagtgatcgagtcagactaatccgaagcacatcatacgaggacaagaaaggaggaggacgtgaccattgctgctaacggcgtggacctgtttctgccggaaacatacgacatcgtctggtcgctgatcattctgatcattgtggctctgttcttctataagttcttcctgccgaagttccagtctgttttcgatgagcgcaccgcaaaaatcgagggcggcctcgccaaggcggagcaagcccagaaagatgccgaagaggccaagaagaagtaccaggctcagttgagcaccgctcgcgtcgaggcttcgaagattcgcgacgacgctcgcgcagaggcttcgcatatcatcgcggacgcccgttcgcgtgccgagaccgaggccgcgcagattaccgcgaatgccgaacgctcgctggaatcccagcagcagaaggccatggtgaatctgaagggtgaggtcggttctctggccacctcgctcgcttccaagattctcggctccgagcttcaggattctgctgtgcagacgcagatgatcgaccagatgctcgccgacatggaaaacgacgaaagcaagaagtagtgctacgtcacccacgtgcgcttggcgcgcgtatgagtgaagaaagggaggtgaccgatgcaaggagaggcgtcacgcttggcggatcgcgaatcgcgcgattcctttgccgccaagctgcgtgagtcgggtaacgatgcgtgggagattggcaatgagctgttcaccatcacgtacgtgttcgaccacaatccacgcattccgcgtgcgctcactgatcctggccgaccgacggaagacaaggtggcgttactcaacaatctgcttggcaagcaggcgttgccgctgacgatggagattctcaccgatcttgtcggccgcagctggagccgtgcaggtgacatcgacaacgcgatcgaggatttcgctgtggatgccatgatgtatcaggccgacgatgagaagaagacactcaaggtctccgtccagctggcgcagctgcagtccgcactgctcaacctgccggtcgtccgctcggatctgtccgacagccaagggcccctgaacgtccgctacgaactgctgcatgcactcatcgatggtgcggatttcgaccgcatcaccgtgcgtctcgcagagcattgcacacgcaacccgcgtaaccgtcgttacctggaatcggtgcaatggctcatcaacaagttctcccgccacatgggcgaatcgatggtcaccgtcacgacggcgaccccgctttcggacgagcagtccgacaagctggcgcggatctacacgaagaagactgggcgcccggtccatattcattcggtggtggatccgaccgtcatgggtggcatgcgcatccaggtcggcgatgaggtcaccgacaacacggttgtcgcacagctggagaacctcaagcgcaaggtgaaagccggagtgagcgagtaggttgcgcgtggccggcctacaaggctggccgattgaatgtatacacaaacataaggagtgatcatggcagaattgaccattgatcccgccacgatacgcaaggcgctcgacgatttcgtcgaagcctatacgccatcggagacgccgacccaggaagtgggccatgtggcgaccgccggtgacggcatcgcgcatgtgacgggactgcctggttgcatggccaacgaactgctgacctttgaggatggcacccttggcctggccttcaaccttgacgctcgcgagatcggcgtggttattctcggcgatttcgtaggcattgaggaaggtcaggaagttcgccgtaccggcgaggtgctgtccgtgccggtcggcgatgggttccttggccgtgtggtcgacccgctgggccggcccatcgacggcatgggtgagatcaagagcgagggaaggcgcattctcgaggctcaggccccggacgtcatgcaccgtcacccggtcgaccagccaatgtccaccggactcaaggcgatcgacgcaatgacccctatcggccgtggccagcgtcagctcatcattggcgaccgccagacgggcaagacggcaatcgcaatcgatacgatcatcaaccagaagaagaactgggagtcgggcgacccgaagaagcaggtgcgttgcatctacgtggccatcggccagaagggttccacgattgcctccgtgaagcagagcctggaagaggccggcgccatggagtacacgacgatcgtcgcctccccggcctccgattccgccggcttcaagtacatcgcgccgtacaccggttcggccatcggccagcactggatgtacaacggcaaggacgtgctcatcgtgttcgacgatctgtcgaagcaggccgaggcctaccgttcgatctcgctgctgctgcgtcgtccgccggggcgtgaagcataccctggcgacgtcttctacctgcactcgcgcctgctggagcgctgtgcacgtgtgtccgacgatctgggcggcggctccatgaccggcctgccgatcgtcgagaccaaggcgaacgacgtctccgcatacattccgaccaacgtgatctccatcaccgacggccagatcttcctgcagtccgatctgttcaacgcaggtcagcgtcctgccgtcgacgtcggcatctcggtgtctcgagtcggtggcgcggcccagacgaaggcattgaagaaggtctccggcacgctgaagatctcgcttgcccgctaccgctcgctggaatccttcgccatgttcgcctccgacttggatgcggcctcgaaggcacagctcaaccgtggtgcgcgtctgaccgagctgctgaagcagccgcagttctcgccgtactcgatggagcaggaagtcgtctcggtgtgggccggcacgcacggcaagttcgacgatctcgctatcgccgacgtgctgccgttcgaacatggcctgctggagtatgtggatcgcaacacggatattctcacgacgatccgtgacaccggcgatttcacgaaggagacggaagaggccctcgacaaggcggtggacgccttccgtgaaacctacgtcaccaaggcaggcaagccgctcgtcgacaagaagaccgctcccaagagcgtcacccctgtcgaccaggagcagatcaaggccggcaaagctcaggaaaagaagtaacctatggcatcgcaactcgcattaaaaagcaggatcgcctccacgggttcgttggagaagatcttcaacgctcaggagatgatcgcggcttcgcacatcgcgcaggcccgccagttggcgctggattcgaagccgtacactgatgcgattttcgatgccgtccagaccttggtgtcgcacacgcatatctcgcatccgatcgtcaagaaggacgaaggcaacccacgggtcgccgtgctcgccctgacggcggatcgaggtatggccggtgcctatacttcgtcaatcattcgtgagaccgaagatctgctcgcccgcttggaaggcgagggtaagcagccgcagctgtacgtgtatggacgtcgcggggtgtcttactaccattaccgcaaccgtccgttggcgcagtcttgggaaggcgataccgagaagcctggcgtcgaggtcgccaatgccatctcccgtgcgttgctgaaggcatacatggaaccggtcgacgagggcggcgtcgccgagctgtacatcgtctacaccgagttcatcaacatggtggtgcagaaggtgcgtgtgctgcgcatgctgccggtcgaggtggtgaaggaagacaagtcgcatctgaatgtgccggacacgaccactgcgccgcaggtgcgcccgttgtactccttcgagccgagcctggacgaggtgctcgacaccgtgctgccaaggtacgtgcgttcgcgtatccatgaatgcctgtttgaagcggcggcctccgaggtggcctgcaggcagaacgccatgcataccgctacggagaacgcgcgtgatctgatcaacgatctgacccgcaagctcaacgcttcgcgtcaggcgtcgatcacccaggaacttaccgaaatcatcggcagcgccgatgcgttgaacaaaaaggaagagtaggaacgcgaaatggctgagaaccaagctaatgcggccgctgacgaggctgcggagccaatcgttggtcatgtgacgcgtattcagggttcggttatcgacgtcgaattccctgtgggccacatgccggacatctataacgcgctgactgttgagatcaagcagatgggtcagcaggaggaaggcgaggtcaaggactccgtcatcaccctcgaggtcgaacagcacctcggcgactccaccgcgcgttgcgtggcattgaagtccaccgacggcttggtgcgtggcgccatcgtgcacgacaccggcggcccgatcgaggtgccggtcggcgatgttaccaagggccatgtgttcgacgtttccggccacattctcaacaagaagccgggcgagaagatcgtgatcaaggagcgctggcccatccaccgcaacccgccggcattcgatcagctcgagtcgaagacgcagatgttcgagacgggcatcaaggtcatcgatctgctcaccccgtacgtgcagggcggcaagatcggtctgttcggcggcgcaggcgtgggcaagaccgttctgatccaggagatgatccagcgagtggcgcagaaccacggcggcgtctccgtgttcgcaggcgtcggcgagcgcacccgtgagggcaacgacctgatcggcgagatggacgaggccggagtgctcgagaagaccgcgctggtcttcggccagatggatgagcagccgggcacccgtcttcgtgtgccgctcaccgcactgaccatggcggagtacttccgcgatgtgcagaatcaggacgtgctgctgttcatcgacaacatcttccgcttcacgcaggcgggttccgaggtgtccacgctgcttggccgcatgccatccgcagtgggctaccagccgaacctggccgatgagatgggctccctgcaggagcgcatcacctcgacccgtggccattcgatcacgtcgctgcaggccatttacgtgcctgccgacgattacaccgacccggcccctgccaccaccttcgcccacttggacgccaccacggagctttcccgtgacatcgcctcgcgaggcatctacccggccgtggatccgctggcctccacctcgcgaatcctcgacccgcggtacgtgggccaggcgcactacgactgcgcgaaccgcgtcaaggcgattctgcagcgcaacaaggagcttcaggacatcatcgccctcatcggcattgacgagctcggcgaggaagacaagaccacagtgaaccgcgcccgcaagatcgagcagttcctcggccagaacttctacgtggccgagaagttcaccggtgtccccggctcctacgtgcctgcggaggagaccatcgaggccttcacccgcatctgcgacggcgtgtacgacaacgtgccggagcaggcattctcgggcatcggcggcatcgaggatctcgagaagaagtggcacaagatgcagaaggaatacggtgactgatggcaggcgcaacgattgcagtgaacatcgtttcgtcggagcgcccggtctggagcggtgaggcgaagcaggtggtggttcccgcctacgcgggtggcatgggcattctgcccggccatgagccagtgctttcggtgatcgaggaaggccgtttggacgtcacagacccgaatggcaagaagttctcgttcgaggtgacgggtggcttcatctccttcgactccaacaaactcaccgtggctgttgaaaacgcgcgttccatcgcgttccaggcggagggtgccgaccaaagcggcatcgtgggctgaacccaacgccaatcccctcagtgggccactcgggctttccgggtggcccactcgcatattgggcgacagaatatgccgttcaggcaacgatttccagaccttggtggttgccgtgggccggattgggcgggcggcagggcctcgtcactggatcgcaagcgccctttacgttcctcaaccctgccgcccgcccaatccggcccacggcaaccacacgtcaacgcatggaattggcggaagccttgaggcgttgctgccggtgattggtgtcggatgcggggcggtgcggaaaggttgaggaacgtaaagggcgcttgcgatccagtgacgaagcctttccgcaccgccccgcatccgacaccaatcaccgattagaggcatgggcgagcagggttgggggagaggggccgctagccttgacggcatgcgaatcattgttgcagactgctgcgccgaatacaccggacgcctttcggcctccctcccgctcgccaaacgagtcctgctcatcaaggcagacaacagcttgctcatcttctcggagatcggctcgtacaagccgctcaactggatgctgtccccgtgcacgatcaaagacatcaccccacaggacgccgacgatgacccggcaacacccacgccggagaagatcattcgcgtgcagtccacgaaaacgaacgatgtgctcgaagtgacgctgcagcacatctacagcgacgagacgcacgatctgggaaccgatccgggactgcgcaaagatggcgtggaagaccacttgcagcggtatctcgccgaacagatcgagcgcataggggagggcgccaagctcgtgcgccgtgaatacccgaccgcaatcggcccggtggacatcatggccatcgacgccgacggcacgcatgtggccatcgagatcaaacgccacggcggcatcgacggcgtggaacagctcacgcgctattgcgagttgctcaaccgcgaccccctgctcgcccctgttcgcggcatcttcgccgcacagacgatcaccccgcaggcgcaggtgctcgccaaggaccgcggtttcgactgcctgctgctcgattacgacgacatgaagggcaccgatgacggcgcactgcgcctgttctagatggccggtatctgcccgaatatggaagcgctccgtgggcctgaggcccacggagcgcttccatatcaatgcgatatgcgaggttgccgatcagtacttcgcgagaatgtcgacgacgaacacgagcgtcgagttcgccgggatctcaccctgcgcctggtccccatacccgagcgacggcggaaccacgagcagcacctcggaaccgaccttctggcccttgaggccttcgagccatccctcgatcacgccaccctgcatgttcacgtcgaaggtcgaattgcggtcccacgacgagtcgaactgcttgccgtcaagcagccagccggtgtatttgaccaccgcgtagctgttcgagtcgagcttctcgccgtcgccttcgatgagcggctgcaccacgagcttgtcgctgtccttgtagccgttcatgtcgatggagggcttgccgtcggctgcattcgtcaccttcggcagatccgacggaatgtccttcaccttcgtgccctcggccttcgtgaggtcagtggactgcgacttgagtgtcatcactatgagattggatgagtcggcggtgctgtcattgctgccgaataccacggtggagttaagcttgaggccatcaatcaccgacagcaacgcagatgttttttcaccttttttaggcgccactagtgagcaatccatctggttggtctcccaagtgctcatcttgatatcgcccgttttaccgtccacggccattccctgtgcacatacgcggttgcctggcttgattacctcgccgtctccttcctgcaagatggcataggaattatcaggaacattgagcggcttcttgaattcgaggaccggcttctcgcccaccttcgcggtgtccttcacgccctcgatcttcgtcaggcccgagctggcggaggaagaggcggaagattttccggtggattcggatgcattgctatttccgcaggcggcgaacgcaaaacatgtcgcggccacgcacatcgcggccacggcttgcaccgcccgtttgcggattcctgctgatttggcttgtgtcatacctgccaagaatatccgcgcgcatgtatttcgccgaatgtatatgcgctcaggcaagaagctgaatctgcatacagcgctagaatagaagagatatgacagacatacacgaacagcgagagcagactcgcaccaagaaagagccgacgcgccacgcgaaaatcatgcgcggcgtggtgacgccgatctttggcctcctggcggtcgcctgcatcgttttcggtattctcaaccagaccatctggcagccgaatccgcagattgccgcgaccgcgccggtacggaacacgcaatacctgctcgtcgaccaaggcgtggccaatctggtcgacaagaacgttcgaattgaagccgcaagcccgagcgccaccgccaacgacggcgtatgcatggcactcacgtcgcccaaggatgcggctggctggctggcggggcagccatacgagcgcatcaccgggctttccaattggtccacactgtcttacgccgaacagggtgcacaaggcgaggcgaacacctccggcgccgacgtcgccttcaaggactcgaatatgtggaaagaggtcaactgcggtgccggcaaggcatccctcgacctcaaggacgcggccggcaccgatgtggtgcttgcggacttcggtcagaaggtttccgatggctcgcttgagatgcattggacccgtcatgacattccgaacttctccatcccgtggtatttcgcgggcggactgtgtgcggtgctcgccgtgctgtgcgcctcggtgttcgccatggacatgagcgcgcgccgcaagaaagtgagcgaagacgccgaacgtgcccgtcaggagcggcaggaacagcgcaaggacgaaccgaagataggcgaggcgcttgcaggctccctcgcggcgctgaaaccgcggagcaagggcaagtccaagaccaagggtggtcctcgtcacggcaggcatgccggcaagcaggaggatgagcagccgacaaccccgaccatcgtggacccgcacgcacgaaatctggtggcggaacaggcacagcaggcgaacgagaacgccagcgtggaggtctccgtggcgaatggctccgatgaggcgagcgaaacggccacgcggacggtctccaatgacgggtctgccaccgatggcaccaccacttcggtgatcaccgaagccgagctgcaggactacttcgcacgtctggcccgcgaagtcggcatggaatcgtccacgccgtccgagcagggcgagccagaggccgagcgtgtgcaggacactgacgaatctgaatcctccgaagacgaacagtctgcagaatccaatgaatccactgaatccacggaacccgaagacgtcaccgagacgagcgagggcggggaagcctctcaggaagaaaccgaaggggagcagtccgcggccgccgagtcgggcgacaaggagggcaaatgaacacgcgtaggaaagccgtttctctgggtgcagccggccttgcgttgtgcatgtgcgtgacgcttggcgcatgcgaagggcaattgccggaaccggtgcaggcgaccgcctcggcttcggcgtcaccgaatctcaccaccgagcaggagaaggcgatacgcaagcagctgctcgaagccattgagcaatgcaacaatgcgaagtcggcggacggcctcgaccgtgcgatgtcgggcccggaactcgagattcgcagaagcgagctcgccgtggcgcagaagaccggcaatctcgatccgaagaccgacattcccgatgcgatcacacagacgatcatcccgaccgatagcggatggccgcgcagcgtgttcacgatcaccacgaccacgcaggaccagcagtcgaagcgcctgctcgtgttcgatcaggaaagcgcacggcagaattacaagctgtggggagtcgcgcgcctgttccaaggcgtgcagatgccgaagttcaccgtgccgcagatcggcgcgcagatgggcaccgacaacgacgacaatctcaagatgacgccgaaggaagcggtgaagcgttacgcggacgtgctgcagaacggcgacaagagccagtatgcaggcgatttcgacaacgattacctgcggcaggagctcgccacgctctcgcagaccgtgcaacagggcatggagcgcaacaagggcacgcaaacgcagaccttcgagccggtggacggccagatgcgcattatgcgtgcggctgacggcggcgatctggtggtggcgcagatcaactcggtgtggacgcgcgcagcgggcgagggacgcgagtcccagccggcctcggattccgagaaggcattgttcggcgacgcgaaggccacgagcacgatgcgcgtcacctatgtgaacgtggtcgccctctacataccgtcggccaaggcgaacgcgaagatcacggcggtgggcgcggaacgccagccggtcaaggtcgaggcgatctaacagtctttttgcacgcgcatattgcaaacgttcaacagtgcgcgaacacgcgcggaaaggggcatcatgccggaacgtgaaatcaagccgggaatctcattggcaggggccatcgacctcgagggactcaagcatcaggtcaaggcggagccggggcaagcaggtggcgcaccggccgcgggtggctatgtgatcgatgtgacacagaacaatttccaggccgtggcgcaggcgtcggcgacctacccgattgtcatcttcatgtgggtgcctaccgacaatcgcctgttcgacatggcccgcgaactcggcgacgcggtcaacggcatggacggcaagctgcagctcgcgcgcatcgacgtgagccgcgaacccgagatcgcgcaggcattcggcgtgcagggagcgcccgcgttgttcgctctgatcggcggccgcccgatgccgattctgcagggcatgccgcaaggtgacgaaatgacgcagatcaccacgcaggtgctcccgcagctcgtgcaggtcgcggcgcaggccggtgtgaccggtaccgcgccgtacatcacgccgcagaacgccgacgacgaggaagacacgcagaaggaacccgccgtgccgcctgagcacgccgaagcacaccgtttggctcaggagggcgactatgcgggcgctgccgatgcctacgagcaggtgctcgaacgtgagccggacgacgaactcgccaagcgcgggcgtgcgaaggcgctgctgcttgcccgttccgcgaatgcggatgtgcgcgaggcacgcgagaaggccgcggcaaatccggacgacctcgacgcgcagctggccgtcgccgacgtcgatatgatcggcggccagattcaggatgccttcgaccgtctgctcgactatctggcagctcatccggatgcggtggagccgattcgcgaacgcatgctcgagtacttcctcattcccgaggccaccgacgagcgtctcgcacgtgcacgtcgccgcctggccacgctcatgtactgatcggtcgtatcgcgaccgccattcggtgtccgcattacatacgcgcctgctggcggaaagtcaggcgaacgtgtaaagtagtgcaggcatgggctcatagctcagtggatagagcgttcgcctccggagcgaaaggccgtgggttcgaatcccattgagcccaccatgttgagaagtctggaataccgaaatgccggtattccagacttcttcgttttggctcgtgccgtgggcgcgcaatcgtccacccggatttcggccaccaggattgcaaacgaggtccgcagggatggcgccctgcagacctcgcggaagtggaagaagaaaaaatcagtcagattgtcagagctacatgcacctcctcggttcctgttgctgcggttggaacaacggtgccggagaccggctggccgtccacggtgagcgactgttcgccggtgcgggtgacgtcaatgatgtaccgtgtgccacgccatgtgcgctcgatatgcagctcgccgaagttgggcggcaggtgcggctcgatcttcaggccgtcgaatgtgggctgcacgccgagcagatgctgggagacgtctacgaaggtccatgccgcggtgccggtgagccagctgttcttgccctcgcccggggtcggcgcctcggggccggcgaccatctggcagtacacgtacggctcggtgcggtgaatctcggaatactcctcggtgtaggcggggcaggtgcgcttgtacacgttgaaggcctcgtcgttgttgttaatcttggcgttcgcaatggagatccacgggttgttgtggcaaaagatgccgccgttctccttatagccgcgcgggtatgaggaaatctcgcccaactcgatgcggtaggtggagtatgcgggtgcgaggatcgcggtgccccagcggcaggtgagcagttccttcgtcgattcgagcgccttggccgccttgccgtcgtcgacgccgatgccggccatcacgcacatgccctgcggttcgatgtagatcttgccttcactgtcttcattcgtgcccaccggattgccgttggcgtcgtaggccctgcggaaccaggcgccgtcccaaccagcggtgagcgtggcctcacgcacttcggcgatcgtcttgcgcacctcggcggtctcgttcgccacctcgtcggcgcccatgccgcaggcctcgccgaattgctcgagaatctgcgcatactgctcgccgtacagcacgaacatgccggcgatgattccgggcaccggcttgttcaggaacatcgcccgcgccttcggtgccatgaagttctgggaggcgctcggcggcaccttcctggtggccaccatcgtttcgatctccaccgtgttcttctcgacgctcgccggctactcgttctcgaaactgcgcttccgcggccgtaacgcgctgctcatgctcgtcgtcgccacgatgacgatcccgcagcagctcagcgtcgtcccgctgtacatcatggccaacaaagccggcctgttcggctcgctgtgggccgtgatcatccccggactggtcagcgcattcggcgtgttctggatgacccagtacatcggcgacgcactgccctacgaactcatcgaggccgctcgcgtggacgggtgctccatgttccgcaccttcctgcatgtggccatccccgccgcacgcccggcggccgcgatgctgttcctcttcaccttcattgcccagtggaccaactacttctggcccatgctcattctcggcccgaacaagaacaagatgctcaccgtggcggccgcaacgctcaagggtgcatacttcaccgactacacgatcgtgatgtcgggcgtcgtgctcaccaccgccccgctgttgctgctgttcttcttcgccggcaagcaactggtctccggcatcatggccggtgccgtgaagggctgattcgttccctcctctcattcggccggggtgcagattgtctctgtacctcggcctcttccatatccgcaatccgcagaacatcgaagatgcgtggttccccaatctttcacgtgaaacattcgcgtagcgtggtggggcagcggtctgggctgccacgagtagtctgcaatatgaaacatgagcccacgtgcacactcaaggtgctaaaccagagcatagattcacgccagcgagcgaaaggaacatcatgtacgagaatctgcaggcagtgaccaccatggaggcgccggccgcactcggcgcatacagccaggccgtcaaggcgaacggattcgtgttcgtctccggccagctcggcatcgacccggccaccggcgagctcgacggcgtcaccgcggcggaacaggccgcacgcgcgctcaagaacatcaccaacatcctcgccgccgcgggatgcggcgtcgaacacgtctgccgagcgacgatctacctgcgcaacgtcgaggatttctccgaggtggacggcgtctatgcgaagaccttcaccggcacggtcaagcccgcacgagtggcgttcggcaacaacatgatccccaagggggcgctcgtcgagatcgacgtcatagcggtctgcccgcagaactgacgccacattcgccccgccgtcggcgcacggctgcgcatgccgtttcgcacagcgctagactggggctatgattcaggcattctcaacatacgcgaatgcgcagggcaccacgcttgccgccgcgttcgcgccgcttgggaatgcctatttgcgtgtagggcgcacgccggagagcacgtcacacgccagcacccccacgctcagcatcgacacgactcgcgtgcgccagcccatcgacggcttcggcgcatcgatcaccgaggcgacgagctggctgtggcacaatcgcgtcacagacaaagagcgatgcatccgcgatctgttcagcccgcgcgacggcataggcatctcgatgctccgtcagccaatcggcccaagcgaccatgtgagcgcgccgtaccgcttcgtgcgcagattccccgaccgcaatctcaactccctcgatttcacacccgagatggagcgcgtgttgcccatggtcgaggccgcgaacgactgtgcgctcgccacgcaatcgcatgcgctcaacattatggcgagcccgtggagcgcgccatggtggatgaaaacgaatctcagcgtgctcggcaaacggcgctacacgcggatcaccggccatctgcggcgcggcatgtatgccgcctatgcgcgctatatcaccggttttgcgcgattgtatgcgcagcgcggactgccgctgttcgcgctcaccgtgacgaacgaacccgactacccgcagtcgcgatggccatcgatggcaatgaccccgcgcgagcaggcagagttcgtcgcgcgccatctgcgccccatgctcgaccacgccggattggaaggcacgcgcattctgtgctgggaccacaactactccaccgaccattatccggacggcgccttcgtgcgagacatgtacgccgattccgccgcgctcaccgcctgcgccggctccgcatggcattattacggcggatccgcgcgcacgatgtctcgcattcacgacgcgtttccgaacaagggcatctgggcgaccgaggcgagcggcggcgactgggggccgcgcaatttcacacccgcgctgctctcgctgggcacggcggtcattgacatgatgaacaactgggcgaggagcgccgtgttgtggaacatcgcgctcgacgagcacggcggtcccgactactactacctgcgcaacgatcgccggcattccgagaaccgtggtctgatcactgtgcgtgacgacggttcgatacgccgcaatgcagactactacgcgctcggccacttctccaaatacgtgccgattggctcacgttgcgtggaatgcgcgctcgaccatgcgcaaggtgtgcgtgccgccgccttcctagtccctgccgctcttactcatggtgatggtgaccaggttgttgccgtgctcgtgaactctcgccccgagccgctcgacctgctgtgccatctgcgcggtgcaggcaacggcgtgatgctgacattgccggcttcctccctcacctctttcctggcatgatgtgtaccgtgtggtgatcgtcttcaggtatcttcgattgttaggtgggtggccagagtatccacgcataattccatcccttttattcgacaaaagttgggtgatttgtcgaataaaagggggttttcatgatgttctcctagggtactcaacctaacaatcgaagatgcggacgacgggccacctcacaatcgaggatattcctcaaatctgtcggcgttgccggtagacttgttggaatgagtccagaagcgctacaggaattgatcttcaccattgccaataaccttgtttccgagggtaaagccggcactttgacggccgaggaactcccggattccgccaaattcgccgtcatgcgccccaaggatcgcgcgcacggcgactgggcgtcgaacgccgccatgcagctggcgaagaaagccggcatgaaaccgcgtgatctcgcccaactgttcgccgacgcactgaatggcaccgatggcattgccgccgtcgaagtggcaggtcccggcttcatcaacatcacgctcgactccgcatcggcggccgcagtggtggaccaggtgctcgacgagggcaatcgattcggcaagaacaatcacctgagcggcaagacgctcaatctggaattcgtctccgcgaacccgaccggcccgatccacatcggcggcacgcgctgggccgcggtgggcgattcgatggcccgcatactgcaggccaatggcgccaccgttgtgcgcgaatactacttcaatgaccacggcgagcagatcaaccgcttcgccaagtcgctcgtggccgccgcccacgacgagccgacgcccgtcgacggatacaagggcgcctacatcgacgagatcgcacgccgtgtgatcgtggaggccaacgccgaaggcatcgatattctcaatctgccgcgcgtcgacggcggcaccgacgagaagggcgagccgctgggcgaaggcgattccgagcagcgtgaggagttccgcaagcgcgcggtgccaatgatgttcgacgagattcgccagtccatgaaggaattccgcgtgcacttcgatgtgtggttccacgagaacagcctgtacgaggacggcgaggtggagaaggcgatcgccgacctgcgcaatgccggcgacatctacgagaaagacggcgcgacctggttcgaatcgaccgagcatggcgacgacaaagaccgcgtgatcatcaaatccgacggcacgtacgcatacttcgccgcggacatcgcctactaccgcaacaagcgccaccgcaagaccgacccggccgacgtcgcgatctacatgctcggcgccgaccaccacgggtacatcggccgcatgatggccatgtgcgccgcgttcggagacaaaccgggcgagaacatgcagattctcatcggccagatggtcaatgtgatgaaggacggcaagccggtgcgcatgagcaagcgcgcgggcaacatcgtgacgatcgacgacctcatcgacgcgattggcgtggacgcatcccgctattcactggcccgcaccgactacaattcgccggtcgacatcgacctcaatctgctcgcctcgcattcgaacgacaatccggtgtactatgtgcagtatgcgcacgcccgctcgtgcaacgtcgaccgcaatgccgaagccgcgcaaatcaatgccgccgacgccgatctctcgctgctcgacactgaggcggacggcgaggtgatcgccgcactcgcgcagtggcccgcactgctcacgctcgctggtgacctgcgcgcgccgcatcgcatcgcgcactacctggaagacctcgccgccgcataccacaagtggtacaacgtcgagcgcgtggtgccgatgccgctcaccgaagcggaggagcgcgccgatgagcagacccgcgaacgcacccgcatcgcgaagaacccggagcccgcgcgcgcggccgcccgactgaagctcaacgacgccgtgcagaccgtgatcgccgaaggcctcgacctgctaggcgtgaccgcccccgacaagatgtaagtccgctttccggcgtgcggtcctcctggcctcctctccgccttctcttcctttgtggacttagtgctttgttgcccttgtgtaaaaagagacgtattcgagccagcggatgtctctttttacgcaaaggggggagaggggaagagcgggggacggaacgaagaagataccgcaaacgagatgaggagatgaatatggccatcagtccaatctggccggcagacacggccaggaattccaacggcgagctcacgttccacggcatcaccgccagcaccctgctcgacgaattcggctcgcccctgtacgtgctggatctcgacgaggtgcgtgcccgcgccagccacttcgtgaaggccgccgcacacgcgttcacgaacaacaccacgcatgtgagctatgccgccaaggcgttcctctcgaaggaaatggcgcgcattgtgaccgaggaaggcatgttcgtcgacacctgcacgctcggcgagatgaagatcgcgctcgccgccggcgttcccggtcgtcgactggtgctgcacggcaacaacaagagcgatgaggagatcgaactcgccattgccgagggcttctcgaaaatcgtgatcgattcgccggacgagcccgcacgcatcgccgcgattgcggaacggctcggcaagcgcgcccgcgtgatgctgcgcgtgacctccggcattcacgccggcggccacgaatacgtctccaccgcgcacgaggaccagaaattcggcgtcgcactgctgcctgcaggtgccgacaccgagatcgtcgacaacatcgaccagctgcaggacgtctccccggcggccacgaacgcgctcgtgcacgagaccgagctcgagcggggcggcgagacgaagcagcaggcagacaggcagctgcggtacgacgtgcgctacccgtacgatctgaacgccgccgacgtgaccgagggtgatcgcctgcttgccgccgcgatggagctcgtggccaacggtccggccatcgccgtgctgcgtgagatcgccaagtacggcaatctggaactcgtgggcgtgcactcgcatatcggctcgaatattcacgatgccgaggcgttcattcaggcggccaagcgcatgatgctgctgcgcaagacgttctatgcgacgaatgcctacacgctccccgaggtcgatctcggcggcggctattcggtcgcctacaccgacgatgaggaccgcatggacgtggaccgcgaactcggccgtcttgccgacgccgtgtcgaagacgaaccgcttgctcggcatgcccgcgccgatcatctcgttcgagccgggccgctggatcgtcgcccccgccggcgtgacgctctaccgtgtgggcaccgtgaagaccgtgcagcttggcgacggcttcacgaacaacgcgggcgagcggattcgcgaacgcgcatacatctcggtggacggcggcatgagcgacaacattcgccccgcgctctacgacgcgaaatacaccgcgattcttgccaaccgcgagtccgctgaaccggcgaagctctcgcgcgtcgtcggcatccactgcgagtccggcgacattgtggtgaatgaggcgaatcttcctgccgacgtgcaccgcggcgacatcctggccgtgccggtcaccggcgcctacggccgttcgatggcgagcaactacaacatggcgctcattccggccgtcgtcggcatagacgggcatggcgcgcatgtgatgatgcgtcggcagacgatcgacgacctgctcgcgctcgacgtgagcgagtgaatggcaaacacctgccacctgcgtaatcggggacaattccgcccggtgatctgtccccttttacgtagattcccttcctccgtgcaggtctccctcttgcgtaatttgggacagatccaggcgttttctgtccacttttacgtagatcacgcaaagagcggcggatttcgattccacagacagagcgactgcgtacgcggctatacacctccacgtacaatgacctaagcaaacctgtgaacacgcagtgtgcaccgcatgaaaggattcccatggcagaacagaacgccccgatccgcgtaggcttacttggagccggcaccgttggctcgcagacggcgcgcatcctggtcgagcagaaggacgagctcgggcagcgcattggccgtcccctcgaaatctccggcatcgcctgcctggacccgaacgaggtggacttcccgtggatcgacaagtcgctgctcaccagcgacacgatgtcggtggtgaagaacgcggacattgtggtcgagctcatcggcggcaccggcgtcgcgcgcaccttcgtgttggaggcgctcaacaacggcgcgtctgtggtcaccgcgaacaaggcgctgctcgcgaagtacggcccggaactgtataaggcggccgaagacaaccatgcggatatctacttcgaggcggcggtcggcggcgcgatcccgatcgtgcgcccgctgcgcgagtcgctcgtcggagatcaggtgaagagcatgctcggcattgtcaacggcacgacgaactacattctcgacgagatgaccaccaagggcctcgatttcgacgtcgcactcaaggaggcccaggagaagggctatgccgaggccgacccgaccggtgacatcgaaggctacgatgccgcgaacaaggcggcgatcatggccacgctcggcttccacacgaacgtcggcatcgacgacgtgaccgtggaaggcatcacgcacatcaccgccgacgacattgccgccgccaccgcggaaggcaaggtggtgaagctgctcgccgtggtcgatcacaccgaagacggcgtctccgcacgcgtttaccctgcgctcattcgcaacgagcacccgctggcgtcggtgcatggctccttcaacgcggtcttcctgcacgccgagtatgccgatgacctcatgttctatggccgcggtgccggcggcgcccccaccgcttccgcagtcgtcggcgacatcgtcaccgtcgcgcgccacatcgcctccggttgcaccggtccggcgatccgcatgtacaacgactacccgatcgcgccgctcagctcagccaaggcgagcttcgccgtgcgcttcctcattcacgacaagccgggcgtgctgttgcaggtggcgaaggagttcgcagaccgcggcatctcgatcaacggcgtgaaccaggacctcaagcccacggcgaccgaaccgggctatgacggcgagatccagcagctgcgcctggtcacgcatatgaccgacgagacgacgctgcgcgaggcggtcgacgcggtgtgccagcttgactcggtgaccggcgacccatcgatcattcgcgtgctcgactgataatctgttatacatagaccggcaattcgtattgccctgaccgtcagagtaggaagtggaaaatggatccggtgactcgtaaagtccacgttcgcgtgccggcgaccagcgccaatctcggctccggtttcgacaccgtgggacttgccttggattaccatgacgagctcgagttcacgctcagttccgatccgctcaacatggcggcacagattctcatcaccggcgaaggcgagaacacgctgccgcgcgacgagtctcacctggtggtctccacgttccgccgcgcatgttcgcgctttggcctgagcaaatgcgggttcatcatggaggcgcacaacaacatcccgcaggcgcgcggcatgggctcgtccgccgaggcgatcgtggccggcatctccgccgcctacgcgttctcgcacgagggcgagctcgaccgcgacgtgatcttccagtacgcggccgacctcgaagggcatcccgacaacgtggcgcccgcggtatacggcggcatgaccgtctcgtggaccgaggacgggcaaagcgagatcgtgcagggcgaggtggtgaacaccggcttccgctcggtgaactacctcgtcgacgccggcgtgcgcgcctcgattttcgttccggattacgaactctccaccgcgcaggcccgcgccgcattgctgaacaccgtgccgttcgcggacgccgtgttcaacgtgtctcgcatgggactgctgatcggagccatgaatccgtccgcgttggcaggggagcaggacccgaacgaactgctgttcaccgccacgcaagacaagctccaccagagctatcgcgcgccgctcatgaagccgtccgccgaactcatcgatttgctgcgcgagcacgggtatgcggccgccgtatcgggtgccggcccatgcgtttgcgtgctgcacaacggcgacgcctcggacgacctgaaccagattgccaccgcccagctcgcatccggccactggcgtgtgctccacctcaacgtggacacgcagggtgtgcaggtggcgcggctgtagctccagcctcttttgcgttcgggacgggtaagccgctgatggtgtctccttttacgcaaggagctatcgaattcattgaatctattacgtaaaaagggacagattaaggttgtatctgtcttttttacagatttgtagaatgtatgttcccgatcatgccaccggcttgtgcatgtgtttataaaatgcttggagagtgactctccatgttgttgttcgcaacgcgcttgagatggtagtgtgggtgaaacaatgcgatcaagggtgaaagcgcagggggtttcagatggggcagcttggatattcttcggatgatggattggctctgtcggcgcaagcgcgcgctctgtggggaaagaccgatcgggatgtgggggaggagtggcttccgttgtatgtgcatatgtcggattcggctcttgtggccgagaaaatctgggatgagtggttgccggagggtacccgggaaatcattgcgagtaatttcaatggggatgccacactagcgaaaagggtcactgtgttccttgcgggcatccatgatttaggggctcttctcaggttagtgtgtaaggatgtctttgagttggctgctgtggatgaggcatcgttggatgtagctggtggtgttggcgaagcccatggcgttgccgcgcagggtctcgagcctgccgttgatggcttcggtgggtccgttgcttgagcgggggtggcggaagagggcgaggatgtcgcgcatgcgtcttttgagcacgcggccgagggaggcgagttcccggcagcctttgtagcgccccggtccggtcaggtcgtcgatcagctcgcgcatcatgcgttcgccgcgtcgcctgtcgtcgcaccggtaggcgtgtatgaccctttggtaggcgtcgtgggcgagcatgaggtcgcggttggcctggatggcgaacagggccatgagtctggcacggccgcgtgcgccgaggtattcgtcgctggtcagcagggcgcgcctgcagtcgtagagcctgtcgcccttgacaccgcgcctgccggtggcgtcgcgttgcaggcggcagcgcaccttggtgacgcgggcggcggccagttgcacgacgtggaacgggtcgatgacctcgaccgcgtggggcacgacggattcgacggcctgcttccagccggcgaacgcgtccatggcgaccaccccgacgcgtcttgtgaactcgccgccgcgcgcctgcatccattcgcgaagcacctgggcggaacggcccggcaccatgtccagcagtcttgccggcctgccgtcgcaacgcggggtcaggtcgacgatcacggtcacgtaccggtcgccgaacgcgccgtggcgccacacgtgctcgtccacgccgatcgcgcgcaccgaggagaaccggtcggcctgctcgagcaacagcatgccccgctcgcgcaccgcccggtcgaccaccgcccatgccacatgaagcagcctggcgcacgccgagaccgtcatcgagtccaggcacacgcgccgcagcgcccacatcaccgccggcacgctcaacacgcccctgccggcgcccaccgcctcaagatcatcgctccacgagcgtgagcacggcacgcactcgtagcggcgcacgcgcaccagcagatgcaccgcgtcgtcgccgtagggcacatgcgccagcgtgcgcagccacgacgaacgcaccctggcatacgcgccgcacgaggggcaccagcgcgcgtcgtgcgagtccggctcgcacctgatctgccttaaccccgggccgtccggcctgccaagacgccgccacgagagcacacgaagacccatctcatccaaaccaaggaaacgttgggggtcgaacacgctaaactcgggttcaggccgtgtttcctcattcaatttctctatcacacaagcaatgatgaagcacggcccttacacactaacttgagaagagccactatacctgcgacgaagagcaggctctcatctgaatgaggcatgcgtctcagaagctaccaaaggggggcggcaaccggaacgcatgccatcacaaaccatagcacgtatttgcagaccatggattcggtggctgtccgcagcagagatgaccggaccagattgtaaatctggcgcatcgcaccacgcagatatgaatcctccctccactacgcgtcgcggacccacacgccgtgtcgctaactgtgcgcgccaacggcaccgatggaggatcgaaattacataatctcaacgttcggtagtatctctgtgtatatttcgaacgatggcatatgagtgcttcaccgagatagtgttcgcaatatcgacgatctggcgaatactgcaagggcttttgctgagattgcgtctgcaagaccgatcttcctagcagtgccttggttgtcgttatgagactgcgcttgcggcgacggcaatgctagagcttgctcgatgaccattgcggccaaccgattgcaagcatggcactttaagttcgcctgctgtggctttcgcttgtgtccgcacaagaccaagattgcatcatgctcaacgagctgctcggcaaatggtatatacaaaacaatgattgtgtgattggcttggacgagtgcggcgatgctctcttccgagggcacgcggtactaatctggatactcaatttgaaagcacggttctcattccaaaatccggcaatcgacggaacacttcattgtgcatgcgattcggtttacgacgatctgcgatatattaccgccgcacaccccatcaccgccgccaacgcaagcgcccgctgttatctgccttgcacgtgtatccgacgcccttctgcgaaacgcctgtctccccggctgtggagcagaaggcacctggatgcactattcgcgatgtctgctgttctacgacctgcggagcctgctcttgctgccgagccgcttcctccgccgctgcttgtgccgcctgagcctgtgcccgctcccgttccgcggcttcggcctccgcgcgcgccttctccgctgcggccgcctgctcctgctcggccttcttgcgctgtgcagcctcgacctccgcctgtttcttcgcctcctccttgctggcgatgctcttctctcgctcgtcgagttgggtctggcgctcgctttgtgacttctgctgctcgtcgagctcacgcttcagtttgtcgagttcctcggcttgcttgttcagagcctcctctcgccgtttcaattcggcgtcgttctccttggcgtcgatctgctcggtgggcgcgactgcagcagacgggaccgttcccgccggtttcgaagcattcgaggaacccgctcccacgccgagtgcaaacaccatgaggaaggcaaacgcgtagatcagcaccttgaatcgtttgcgtttctgcgggggagcggcttgtgcggcgacttgcatgcccgtggccggaccattgggcatggttgctgtcggcatgtgttgagattgtggccgatccgttcgcccggttcggccgaatggcatacgccttgtcgtctggctctcgctctcgttcgcctcattcttgacttggccgagcgacatgattgactgtcgccagtcgttctttggcgctttcttcttgccgttgaacatgacagcacctcgcttcgttgcgggtccgcgacatcgtcgtcgcagattactccagctgctggaaccttctcaagattacggttccaattctaccgctggaatcgcagaggattcccgattctcccgcatggccccaaaactgctcgcgtggtaaacgaaacagcatgaagtgtttgtggaaatgaagttggcgcgcctaaattgcctgtttgagataccgttctctatattggcgcttttgtcggtgctgtaagcgcctccttgagactgggcttgcaagaccgaccaccctggcggcgcttcggttgctgttatgaggctgcactctcggcaacggcgatgttggagctcactcgatgatctttgcggcaggctgtttgcaaacacggcacatttacctcgcctacatggtcgcagtgagaccgaactctccaattgcgcactacaagatatccgctgtagactccgcatctttgatctcaacccgcgccgaatagctattccagaacaaataccaaggcacgttcagtatccgcacgttgctcataatgtcagacgttcccagagcatagcgccatactggcagagggatttctctttctctacaggatattcgattgggaatgactgtaatcgtgcattggcaccatcgctaccgcactttggtgcgattcccggaaactcctcacagagagtgttcttctgcgccacaaagatgtgaagatgcttggtgatttttgcggggaatccgcacaatgtttcgcagtcgcaaacgattgatatcatataaaagttgatattcgatgggaaacgttgaggttgaagcgaaagcctagagatagttctgacttgagcggtgcctctatgcttgaatggaaagcgttatacatggccgagaacgaggtaaaccgctactcgcagagtcaatcgcaaactccagtgcctgcgcatgaaggcatgaccattgtcgatttactgagtattttgcgcaaacatatcattacgattgccgtcacctttgtggtgatacttggtgtggatatactctatacagctatgtctccggtggcgtatacgaccaccacgcagctgtttgcgacgtataacagttccaatgattccgcgaactcctctgagcagtacagcggcagttcatatatcatgagtcagattaagtcgtaccctgatttggcgaaaacacaatcggtattgcagccggttgtggacgagcttaaattggatacaacgcctatctcacttgcgtcgcagattaccgtaacgaatcctacgaacacagcatttgtgaatatcgctgtaactgatgccgatccttcgaccgccgcccgcatcgcaaacggtgtggctgcctcgctcagcaatgttgtagagaaatccctgtacactgccgggtccaattccgcagtgaagctttccattgtgcagccggctcaggttcccacgaagcagagctccccgaagtggagtctcaacattctggtcggcgtgctaggtggtttgattattggcatattggcggcattgctgaaggatgtgctttccaagaaaatccaggacgagagtgatgtaacggatattgtcgacgcgccgataatcggtcgcgtggtgaaggatgatattcttgctggcagttctccggttgtagtcagtgagccagggagtccgattgctgaagacttccgccgtatccgcaccaatctttcgttctccactccggtggaaggtacgaactgccgtcttgtggttgttacatcggcaggtgcttccgaaggcaaaaccaccatttcggtgaacatcgccgccgctctcgctgaggatggtccacgcgtattactcattgatgcggatctacgtcacccctccgtcgcgcataagatcgatatcgatggctctgctggcttgacccatgtgctttctggccaagcggcagtcaaagatgtgattcagcgctactggaagccgaatctgcacatcataccggctggcccgaagccaccgaacgcgtcgacgttgctgaactctcctctgatgactactttggtggccaatgcgatgcagcagtatgattacatcatcatcgacaccgctccaatggtcgtggcgaacgatgccgtgatcttcatgaagcagggtggcacgttggagatggtgtgccgccgagatcagacgctcaagcgtgatctgcacgagatcgcagatgaactggagactctggacatgcctgtcacgggagtcattatcaactgcgctaaggaaaataagaaggcacttgagaatagtaactattactattattcgaatagtagtcctgctgaaaaaaatagaaaaaatcgtaaatcgtaaaataatgtataacatagcaccgcgtgccttttggcgtgcggtgcttatcattgtcgggggcgcgtatggcatcgcatcgagtatcacggactaatgtcaagaggcatcatcgcgtatggccttgggtgttgagtattgtcggtctgtttgtcgcagttcttgttctatttggaatcgcggggttcaatgtatataggcagtcgaaggaggtgcaggcgcatgagagtcgggcgttgtctatgatctctgacttctctacgaagatagacgatgccaatgtgcagaaggtcaaagaccagctcccgcagattcagcaagagaccagccaagcctctgccatcgccaatggtgcttggtggaatatagccaataagattccttatttcggtagtaatgtctctaccgtgcaaggtatgaccaacgtgatcgatgatttaatgcatcaatcggtgccgcaattcatggatgtcgttactaacctgcagcatgcgaatctctcctcaactgacgatggcatcaatcttcgaccaatcatcgactgccagcaaggcatgcagaaagccaatgaatccttacaacaccaagtgggtgcatacaatgcactaccgcagcccaatattgatatcgttcgttcggcttatgcccaaggctcggacaaattgaacgcgctggccacccgtgttgatgcgttgtctagcacgttccgcatgcttcccggattcctgggcaatggtcaaacccgcacctatgctgtgatgtcaatgaccacttccgaaatgcgttcatctggtggtctcattggttctgtgggtgagctcaccgctgacaatggcagtgttcacgttggtgaattcaaggcgaataaggattatttgccgtatggcattggtgatcactctgccgatatggcgcgtgttttctcggatgagggtcctcttcacatgtcattcgatatccgtgacacggcggttttccctgacactgaacgagctgctctggccatgcaatcgatttggaatcgtactccatggggacagcaaaagccgttgagcggtgtaatcatggtcgacccggtgttcgttcaggaaatggtggcgatcaacgggccggtcacgctcgcagatgggacgactctgaatggtgacaatactgcagagtacttcctcaatacggtgtataaacaatacgaagcatcacagacagacgctgtgttcggggaaaccacaggaaacgtcatagctggcatgttcaagagcctgaatctcggcaaactcgttaaaatcggcgaaactatgggcacgatggctcgggagcgccatttcacgatgttctccttcgatgcgaaccttgagaaggaaatccaagctgcaggattcaccggtgagacgccaaatgatccgcagaatccttcggttggaatctacctgaccgagcagaatccgtcgaagatgggctggtatatcaagcgtaccgccaccatcgagaaaacccgctgcgatgccagtggtgcaacatatcacgttgaatacacgctcaacaacacgatgaaggtgagcgacgtggcaaatctaccgccatatatcaccggtgttgatgcgccaaataggggcaaaggtatcgagaagattctgttctaccctcctgccggcggtcgcatcaacaacatcagccaacttaacggagcggtgaatgccgtgcaaaagacaaccatgaacggcaaggagctgtataagaccgtcgtggagattctgccggagcaaagtgtgacgtactcctttgatgtcacggtatccccacaggcacaatctgcactgaccattgatcagacaccattgggatggaaagacacgggtatcaccgtcaaagagccgaagtgctcagcaaaagcaaactgacacgatgatctgaacaggaaatgaccggagccacgaaagctccggccatttcgttagttattggaatcggcatagacagctgtcttattcagtcgcatgccccgcacgtgaaggctccaacgcctgcgcgatatccgcgatcgcatatccaatctgatcgtgcgccacttggaacgccgcaaactccttgcggtaggggtctgcgatatcttccgcctccggcagtgctcgccgtgccatcgatgcgttgcacatcacctcacgcatgcggtcctcaacattggagccatgcagcagattgttctgcccgaagtaccggcacaggttggcgaaatcgctgagcaggaaggtcttcgaccgcacgcgcggtgcaagtgcgacaatctttcggcgctgatgttcggtgaagcatagaatcaaatcactcgacatcgccaattggggcgtgagccgcttcgaacggaattggctcgaatcgatgccgtcgagtgccatgagtttcgcgctcgatgggtcgattgggctgtcgacgagcccctgtgttcctgcgctgtcggtttcgatgccattcgtatggaagaaatgcgggaacaacagttcgcccatgggtgagcggcagatattgcccgtgcatacaaacagcaccttcatcgcgtatgcctttctcgttgctctccgggttgcggtgtacgcatcactgggtattcaccgcagtccattcaatcattcaatcaatagcatcataatagagcgcgctggctacgaatatgcgcgccgttaacgattttcaaatgaatttcacaggcattgtgccatgtgtgtgcgttatggtgggagtatgagtattccgctgattctcgcttcgaagtccaaaccgcgccgtgatctgttgttccatgccggcatttgccccaccattcgcgtctcgcatgtggacgaacccggggtgattgcgaaggccgctgtgggtgccggtgtgagtgttgacgatttgccgatcgccacgaaggtcatggtgcttgcccaagcgaaggcgaacgcggtataccaggcctacaaagatgtcgcagaggtatccacgaatgctcatggtgacgaggtgaccggattcccattggaggctgcgcagtcgactgcagattccgctcatacggatgacgcccagactcgtgatttctcgggcgtgcagttccccactcgaacacagccgatccaagacactgttgttgaaacgcacgggttgacgaatgcgaaagtcggcccgctgattctcggctgcgattcgatgttcctgctcgacggcaaagcgtatggcaaaccacataccgaacagattgcgcgcgaacggcttgaactgatgagtggtgcgagcggcgaactgttcactggccattgcctgatcgatttcgccagtggtcgcatggtgactggtgtgagccgcgcggtgattcatttcgcggaattctcggatttgatgatcgaccgctatattgcgacgggggagccgctcgaggtggcaggctccttcacccttgacggatttggcggcgcctacatcgacagcatagagggagatccgagcggcatcattggtttgagtctgccactcgcccgtgagctcgtgcaggaactcggcatcgattggaccgacctgtggaacgtggcgcgtgatgaacaattccctcagccgctgtcgtcggtcaaggcattgcctccgaaggagaatgtgcatcagcctggtgacggttgggtggattgtgcatgcgggcgtaagcattggggtaccaatggtgcagccggtgtgttgcttgcccgtcgtgatcaggaaaccggcgaggtgacgcatatcgtcatgcagcatcgcgcgacttggagtgccgagggtggtacatggggtattcctggcggtgcgattgccgatggcgagagcccgattgagggtgcgcttcgcgaggcatacgaggaggcgaacatcactcctgccgatatcgaagtggtgggctcatattgcgaggaccacggcccatgggcatacaccacggtgttcgcgttcgagaagccgggccatgaggtgtatccgcgcgccaatgacgatgagagtatggagatcgagtgggtaccgattgccgaggtgcccaacctgaagctgctcaccgcaatgcgagctgactggccgcgcttcgagaagcggttgaatgagattgcctccacatacaagggcagataattcgcgtgtatatggcaatgggctgcacctgcgcaggtgcagcccattgccatatacacgggaaagagtcgagattatcgcttgcccacgtacagctggttgtcgatctgttccttgaacacctggttcaccttcggccgtacgaccttcatcgatggcgtcaagcacttgttatcctgcgagaacgtggtgggcagcacgatgaattttcgtaccgattcggctcgtgagacgttcgtgttggcgcggtcgacatatttctgaatctcggcggcgacttcaggcagaccagcagcctgttcgatggtgaggtcggcggggagtttctgggtgggcagccagctggcgagtccttcctgatccaatgtgatcacggcgccgacgaacgggcgattgtcacccaccactacggcgtgctcgacgattgggcaggtcgagatctcctgttccatcgggatgggggagacgttcttgccgccggcggtgatgatgatgtctttggcacgaccggtcaatgtgatatgcccctcgtcgtcaatcgaagccagatcgccggtcttgagccagccgtcctcggcaaaggtctcggttgtcttctcgggcaggttatggtagccaaggaacacgttctggcctttcacctcgagttcgccggtgggtgagatacgcaccgaggagccgggcacaggctgtccgacggtgcctatcacgttatcgtgcacgcgggtgaaggcgaatggggcggcggtttcggtcaggccgtagccctggatcatcgtcaaaccgatgccgttgaagaaggtggcgagtttacggtcgagcggtgcgccgccgcaggccagatatttgatgcgtgggccgaatgcgctgcggatcgtcgaatacacgagcttctcatacatcgcatgctccgccttctgcttgggcgtcggtgcgatgccggcctgctccatctcggtccattcgcgggcgaactcgacggatttggcgaagagacggcctttccagccggtgcctgccttgcgcgatgccgcattgtagaccttctcgaacacgcgcggcacggcgagcacgaaggtgggttcgaacacctgcatgtcgtggggcagcgttttcgtgctcggcagatacccgatcacaccggcatcggaggtgaaggcgaaatactggatgaaccgtgcgaagcagtgggcgagtggcaagaacagcagcaggcgtgaattgccttcgagtacttcgggcacgcagtcggcggccgcgcgggtgatgctcacgaagttcctgtgcgagagttcggcgcctttcggagtgccggtggaaccggaggtgtagacgatcgtcgccagatcatcggcgttcacgcttgcaatgcgctcgtcgagttcctccgaggagaccatcacaccaagaccttccagcgcttccacggcattcgcgtcgagcatcagaatgcgttccaatgacgggcagtggtcgagcaccgaatccaagcggtcgaagcgctcctgattgtcggcaatcgccagtttcacgttcgaatcgttgagaatgcgttcggcctgcgccgcggaatcggtgtcgtaaatcggcacggtcaccgcaccgactgcagcgagggcgaaatcaagcagaccccattcgacgcgcgtggcggagaagatcgtcacggcatcgcccttcttgatgccgaatgcaatcagacccttggcgatggcacgaacgcggtcattgaactgcccggcagtgagcttgctccacgcgccgtcggcctccttgttctcggtgagcggggagtcctcgccggaacgtgcaatgcggtcggtgagcaaagagtagatggtctcgtcattgcgcacggtgagcgcaggacccggcgtcgtgtattcggtgagcatatgccttatttccttgtcttggcaaataacaaacaatctgcatgaattgctgagcaaatcctcaagcattctaagttacgctggcgtagcaaatctttgtgagctccgacaacgcatggcgaaattgattgtcagattcacacaatcagctgtttttcgcgccggggtctgttgcaaacgcgattcggctgctagattggcacatggttttctcaagtcgaaatgtgaactggagtgtcggatgttcgataagcgcctgtttcccctcgctcccggcgtgcgtgggctcatcgtggcgaaagtggtgtgcctgtgggtcggtctgctcgccgacattgcgttgtctgtcactgctgtgtcgttgatgggcgcagtgctgggccgcaataccgcatatacgttcactgtggtgtcgctggggtggtacgcgctcgcattcgcagtcatcgcgttcatacgattccttgcccactatctcggttcacggttcggcaccgaggcggccgagcgtgtcaaactcggcttgcgcaatgcgttgtatcgcaagctgctcgtgctcggcccgtcgtatcgtcagcaggcgagcacggcgagcattgtgcagctcgccggtgaaggcgtggaccaggtgcagagtttctacgagaagttcgtgccgcagctgttctacgctgtactcgccccgcttacgttgtttgccgtgcttgcgccgatcaatatgcccacagccgtcgtgctgctcgtttgtgcgccgctcatcgtgatcatcgtcggcatggtcgccatgcgcgcgtcccgcgtgttcaagaaatactggggcaagtacaccgatatgggctccgcgttcctcgacaatctgcaggggctggagacgctgaagaccttcgatgccgacgagtcggccgccaggaagatgcacgaggaggccgagaatttccgtgtgatgacgatgcgcgtgctgcagatccagctacgctcgctcaccgccatggatgtcgttgcctatggcggtgcggcggctggcatcggcgtggcaatctggcagctcacgcatagtggtgtcacgatgttccgcaccaccttcgcgccactggatatgttcgccggaccgcagctcggctcgccgggcatgttgctcatcgtgctgctctccgcatcgttcttcctgccgttgcgccagctcggttcattcttccacgtggcgatgaacggcatgacttccagcaagaagatcttcgcgttgctcgacgcaccagctccgcatcatggtgagcagacgctccccgccgggccgatttccgtgcatgcacataatctgggcttcttctatggagacgacgaagcagatgcccaaccggcattgcgcaaggtctcgcttgacattccggcacattcgctgaccgccattgtcggtgaatccggatccggcaagtccacgctcgccgcgctcatcgccggcgaactcgaagggtacagtggctcattggccttcgaagtggatggtgaatccgtcgaagtggctgatctatccgaatccgcactgatggctgccgtctccttcgtcggtgcgcgcagccatctgttcgtggggacgttgcgcgacaatctgatcatggcgaatccgcaagccaccgacgagcaactgcatcacgcgttgcgactcgcgcatatcgatgatttcgtacgcgagcagccggcagggcttggtatgccaatcgatccggcgaatctctccggcggccaacgtcagcgcatcgctgtggcacgcgcgctgctgcatgaggcgccgatcatgattttcgatgaggcgaccagcagtgtcgacgccgaatccgaggcgctcatcatgcagacaatccacgagctcgcgcagtcgaagacggtgatcgtcgtcacacatagactcgccgacacggtggacgcggatatgattgccgtcttcgaccacggcagctgcgtggaaaccggcgactctagcacattgatggctgcggatggccgctatgcgcgcatgttccacgcccaggccaccgtcgaacaagtgcatcggcgtacggaaggcggcggcatacgctacgcgcacacgcagaacgaagtgggcggcgacatgccgaagcgtgttgcggaatctgctgggaaacggaacgctgcgctttccggcattgatatggctgccgacgatgcgatgacgaccgtgcaggtgattcgccgtctgctcgcacaggtgggttcattgcgtccgttgatggtgttggcatgctgctttggtgtgctcggccacttggcggccacgttcatgccggtgtttggcatcatggcggcgtgcgcggcgtttggtcacccggtgtggggtttgtctgtcggctgggccgtgaccctgatggtggtgtgtgcggcgatccgcggcatcatggcctactgcgagcagtacatgaaccacaatctggcgttccgtctgctcgcattgttccgtgaacgtgcgttcgacgcattgcgcagactcgctccggctgcgcttgcgaaccgtggcaacggcgatatgatctcgctgatcaccaccgacgtggaattgcttgagatcttcttcgcccacacgatctcgccgacgattatcgcgctctcgacgaccgtgctttatacggtggcgttgctgttcctgagcccctggtttgcattgttgctggtgatcgcgcatctgctgctcggcgtgctgatgccgcgtctgttcgctgccgcgctccgtggtgtgggttcaaaactgcgcaaggacagcgctgcgcttgacgatcaagtgctcgatgacatgcatgggcttgaccagatcattcgctttgattgtggtgacgaccggctgaagcggattgatgcgtggtcgaggtcattgtggcgccagcgcacgagattgagtgcgcggaacggtgcattcagcggctacgacagcatgatcgtgattgtggtgacggccgtggcggcattgctggcgttgacattgagccttggcaacacgagtgctgctgcaaatatcgccgcattcgtgctcgtggtgagttccttcggccccacgctcgcactgagcgcgttgccggcgaatctgacgcagaccttcgcctccgcacgcagactgttctcggtgctcgacgccgaacctgcagtggaagagcggggaaccgagcaatgcgcatacgacggcatgtcgttggacggggtgacgttcggctatggtgacggtgcgccggtgttgcgtgatgtcacgatggatatcccgctctccgggatcctcggtattcagggaccgtctggacgtggcaagtccacattgctcaagttgctgatgcgctactgggacccacaacaaggcaccgtgtcaatgtccgggcatgctttgcctgccatcgatgcgcatacgcgtaggcggttgcagacgatgatgagccaggagacgtacctgttcgatgacacgattgccggcaacctgcgcatcgccaaaccggaggcgagcgatgacgaattgcacagggctctggagcaggcatccatcgctgctttggtggatgatcttcctgagggcatggagacgcgtgtgggcgaactcggtgatcggctttcggaaggtgaacgacagcgcctcggcctggcccgcatgttcctgcgcgatgcgagcctctacctgttcgacgagccgaccagtcgcctggattcactcaacgaggcctatatcctgcagtcgatcaacgctctggtcgaagagcgtgatgcggctgttgtgcttgtttctcaccgagcttcgacgatgcggatcgctgatggaattcataaagcatgaaaatccgatttatgtaaattaaataaattctctgctattttccagaaattttattattgctgacgactacttcaaattatcggcaagaagaagtttccttgattatatatgagagcgaggttcattagacgatagagttgaagaacgtattgttttcaaaaattggtataaatactgtctctaaattatctccaaatatatagagaaggaacgcattgacgacaccaaatactagcaaaagaagtggaatgatgaatctgagaatcgcgtcgttcgtggagttgattgtctcgcctgaaatgatgttgaggataatcatatagaagattagcgagagcccagtttgcattcgataaatttcgggagtgtaatttatcgtaattggaagaatgcatagagttaatatagtaattttgaaatagaatatgtattctttcttttgcactcctgtcattttcatgctgcttagattagtaatcagtagaaccgccaatgatgtaatgaaaaaaatagcaacacgcagcaaagcgagaggtaaatgaagatcacgagtcagatcgtaggccgcagtggtgtaagcgttaattcggtcattggagccgaataaacccgacagacccgagataaagcgtggggtcattatggctgagaacagcagacagaacacaaatgtgaaaatcgctgcccacttggtattaagcttctttgccacgagaatgataatccagaagaacgctgcagtatgtaccattgttgcgataaagatgcataggcaatacaggatatcgttcttggtcaggaatcttccttgattgtcgccattctgtacgtcgtccagtaagaagcccatgccgaagatgaaaactgaagttgccaaacaattccgcatctgggctacgtcaatagggaaaggatacaccgcataaagcagcagagtcaatatcgggcatgcagcaaatcgaagaattgtgcagctgattaaggtcagcactatgaaggcagaaacgcatttaaatgcctgatacgttaatcccaaagcattgcatgttttgataagcgccatatacagatattcagtgttatcttcccataattgatattcgtcataacggctttgataaatctgttcatctgcattccctgtagtaaaagaggcaataagccaaaggaatactatgcaaacaaagtacagaatataactttttcttttaaagaaggagatagacaataatatgaaataactaacagcttgaatcatggtgatcctaaaaaatcgggcgcaagactactctatgatgtctggttgagctacggacgctatgcgtacggcgtgcaatatgaattgcacagttagtcctttcgtcagagaagcaccggaggtgctgaaagtagacgtatctacattcttaaacatgtactaccgataaccgggtataagaaaatctatttgtatccgttgacccacccccgagcaatttgtttaagcttagcttttttatcctcttcaaaaaaaagtacctgaagaagatttctcatgtttcgagcattacctcgaagagcatgcagatacaacctgtttttcaatggataatatatgttgttcttggaaatgtagtagtacctaaatgcggaatgctcggaataggggattccaagaagtttgtttttcttaacctctccaatggagtgttccagtactgcttctctcgtctgaatgattacatatccagttttacgtatacgatagcagaaatcgaaatcgacgctatcgataaacaacttctcgtcaaaacctccgattttttcccaagcagagagacgagtgcatgagccagatgtgatgcatgttcgcacttccccgtatgtacctgcgggtttgtgtccgataatgccccgatcacgatcttgtataactggagcaacgatagcgattctggaattcattgagaaaaactgtgaaagcgtcgaacaaaaatctggaggacattccgagtcttgatccaaggtgagcatccaggaatagccatcgccctttccggctagtgcaatttgatttagcgcagttgcaatgccttcattctgcgcattgggaatcaatttgcaatgatgggcgtcagcgaggggtcggatatcttctagattacgagaaccattgtcgacaataatcactaagtcgacctgcgcgcaaatagcctcgatgttcttgcggagtaattcaatgtctggattgaaagtaactattcctgcaaataggttttgtctggcagttgtatcattcattatgttcctttgctgcctccgttatggtcggagcaacccattgagaggggtatgttttcaatcctgcacgtgtgccctttatgattgcggatagcacctgtcctttatgccgggctcgaagaaggcttggcaaattaaagcaaaatataaaacctaaataacctttgcaattgtagttgatgtaaccaaccggtccgtatttttttagcttacgattcacgtatataatattgcgattagtatagtacactctaagtggacttacatatttattatatgaaaattttgcaatattcttattatgcaataaattactgaggccaatccaaaattgttgttttcgagaagatttggggacgatttttccgaattcttgatccagcacccatttattggcgcgtttgatggtgtagccggacgctataagtcttctgcagaaatcatcatctacaagatcgatgaatagccactcatcaaatccgccaacgcattcccacgcttttgtggatgtgcagcttgaagaggtgatgcatttagtaattttaataacgttattatcatcagccgtcttcatataagctcgacgcttgtcaataacttgggggcaaaatatggctgtcttgtccctatccttctcaataaggcggcggaaatcgtccaccatgccgtcagggacaatagaatcctgatccattgtcaacacccattcatgtccatccttcatggcgcattccatgatgcgatttagagcgtaggcaattcctttgtttgcattttctgagagatatgtgattctagcatcctcggcaagcggaacatccacagtaccattgttgaaaacataaacatggtcagtctgctcaagaatggcagcgatgcattgctgaactctattaatatcctctgggttgaacagcactacgccagcggcaacggaagctttcaatgtagtttctccatacgaactcgggataatgaattatcggattgtctagctggttcttcaatcgaactaggagaggattatccgtaccattccttctgaatgaatttatcaatgattttgacaatcgataacggatctttgttctcccaaggaatcaggccatcagttccgatgtatattttctcaaagcattcagcaaggttgcccaactcggggtcagccattaggacgtaatgattcgaactgaaggcttcattgttctggatttggtggtcgttgatgtgttcgccgtatttggccagacgagttacggcgataacctttttctttgcattgagggctttcattatagagccggaagcaccgtgagttacaacgatgtctgcctcctggattttctcttcaaactcttctggtgatataaaatccgtatactggtaatgctttggcttatatgatgaagtgccaatttgagcgaacataggttcggacagaacactctgctcgtataaatcatccagcttcttaaatagacgatcaaatggataattgcgtgagcctaccgtaacgaagatcatcagtataaacaccccccataaatcgccttagtgtagaacttcttttggctttcccattgaactatgaacaaatcggaatgcttctccatcttcttaccggcttcggtgggcatgttggcacgtccaaaggtctcaatgaagataaacttcttgtggaagagtacagcaaggagatagaaaggatatgccaccatagtgccagttgtaatgatgaagtccgggcgttctttaatccagatgaccagggcgcgcgccgagttcacgatcatctttggaaccatgaatttgtctttcaaatccgtctgcttcatgaaatatttggcgcgtggcgtctcaaattgcgttttctctgtgacgaaaaaaccttcgtatttttcagccagtgggagcagtttctggagctgctcccagtgccccccggaggaggagacaaaacaaagacggggttttcttttatgaaccacttaacttacttcccttgaatcatatatagatatgtgcgtcgatcttgttctgtagggatagtaccagtatccggtaatgcgagaaagagcagtatagtattaattcacatataatactgtttgtaccactcagcaaatcgcctaagcccatcacggagactcgtggtaggacgatagccgtaatcccttgttaaggcttcagtatcagcataggtgacaggaacatcaccgggctgcatggggacgagctccttatgcgcttcgaagtcatagtcatccggaagcacttctgctcgaatcaattcttcttgaagagtcgttacaaagtcgagaaggttctcaggatggccgcaaccaatgttgtaaagagcatagggaggtacaggcagaccatcctcgcctgtctggcgagttggtgctccctgtataacacgaacaattccttcgacgatgtcatcaatataggtgaaatcacgctgacaattaccgtaattgaagatcttgatggtctcgccggcaagaagtttatttgtaaaaccaaagtaggccatatccggtctaccagcagggccataaacagtaaagaaacgaagacctgtagagggaatgtcatatagtttggaataggcatgagccataagttcattgctcttttttgttgctgcatacaggctgactggattgtccaccttgtcttccgtggagaatgggacttttttattgccaccatacacggacgaactggatgcatatactaggtgctcaactggattatggcggcaggcttccaagatattataaaaaccaattagatttgaacttacgtaagcatcggggtttgtaattgaatagcggacgcctgcttgcgcgcctagattgacaacaacatcgaaatgatgcttctcgaagagccgcccgataagctttttatcggagaggtcgcctttttcgaaaataagattcggatatttggtcagacgttccaaacgagcttcctttaatttgacgtcgtaatagtcattcaggttatccaagccgacaattgtgatgtccggatagctatgaagcagacgttccgccagattccagccgataaatccggccgcaccggtaatgaggatagtcttgccgctcagttccaccggtgttttttgctgcgccggactagaatttgagtcgagctcagaacgattgccgtcagacgcgatgctgggatcctggtattcgcttgacacttgcatattctctcaatccttaaaaccttgttgctctaatttgataagagggtgaattaggttcgatttatttgagcaactacattatatcaaagtatgctccgcgctatagacgaaagcacatgagtttaatgggaatattgaatagaaaataatacaagatatatatataattttttgattatggtcaatctgaagggtgggaagaggctctgcaacaccagctgttcgtggtgttggagtggtatcgtagagccactgctgctgttggtatcatgctgatcgcaacagcagagttgttaagcgttgcccttttagggttttagttcagggcaaataaattatttctcatatgattagaaaaaattcgtgaatccgcgtatccggagtgatttctggatggaatgccgtagctagaatcctgccttgctgcaacgctacagtattgccgttggcctcacacattacccgagcattcgctccggtctcggcgacgaagggaccgcggatgaacacgagcgggaagttctcgatcacgccagccggagtgccatcggcgtggaatgtggcgacattctcggtggccatgaacgaacccagctggcgaccgtaggcgttgcgcctcacggtggcgtccagtgccccgaagtacacgttcgggtcgttctcgagccgctgcgcgagcaggatcatgccggcacaggttccgaataccggcttgccggccttgatgtgctcgttgatcggctcgaacagaccggtggaacgtagcagcttgccctgcgtcgtgctctcaccgccgggcaggatcacgcggtcaatcgattcgtcgaagtcctctcgggcacgcagcagcttccatggggcgccgagtctgtcgagcatcgccgcatgttcggcgaaggcgccctgcacagcgagaatgccggtcacaccggaggatgccgtcgtggcatcctccgagtgttccttcgagatataggaaacgtcaacaaccatgaatagtcctcaacagcagtatcgtgtcattcgccgcgagcggccatgatcgtctcgatctcgtcttcgttgatgcccaccatcgcctcaccaagattctccgacaggcgcgcgagcaaatcggcgtcgcgccagttcgcggtggcctgcacaatggctgcggcgcgcttggccgggtcgccggacttgaagatgccggagccgacgaacacgccctcggcgccaagctccatcatcagcgcggcgtccgcaggtgtcgccacgccgccggcggcgaagttgacgaccggcaatctgccattatcgtgcacatacttcgcgagctcatacggcacggcgagctgcttggccgcctcgtacacctcgtcgtcgcgcagcgaggcgagttcgcggatctgcttggtcatcgtgcgcatatggcgcacggcctggatcacgtcaccggtgcccggctcacccttcgtacggatcatcgaagcgccctcctcaatgcggcgcagcgcctcgccgaggttcttcgcgccgcacacgaacggcacgtcgaattcgcgcttgtcgatgtggtagacgtcatccgcgggggagagcacctccgactcgtcgatgtaatcaatctcaatggcctgcagaatacgcgcctcggcaatgtggccgatacgcaccttcgccatcaccggaatcgacacggcctcctgaatgcccttgatcatcgccgggtcgctcatacggcttacgccaccggcggcgcggatgtcagccggaatgcgctccagcgccatgacggcgcacgcgccggcatcttcggcaatgcgtgcctgctcgggtgtggtcacatccatgatcacaccgcccttgagcatctgcgccaggttcctgttgagttcgttgcgagtggtttccatgagtctcttccctcactgtgcttccgtgtcaacacgacaattagcacacgaacacgcatatctcgggaaactgtccccattgtgaacgcgggcggcagtaaaacactcgggaacacgcaagactgttgtttgcgaacgtgcgcgtttacactgtgcgtatggcacgacgattcaagcgcaaatacggagtgacaccgctcgagagaatcctgatcatcctgctcatcgcagtggtggtcggagcaaccctcggcgtgattctgccgcgcatcaacaacggcatcgccgagatcaccggcagatacacggccactggaaccgctgcggagacgttgaacaagctcgccgtggtggacaggcccaatggcgacggctatgaccgcgatctgttcggattccgcgagaccgacgacgacggcaacgggtgcgatgtgcgcgaggacattctggcgcgcgatctgactgatgtggcatatgtcacgcgcaacggctgcaaggtgaaatccggtgtgctgaacgacccgtacacgggcaaggtgattcatttcacacgcgggcagaacacgagtgccgccgtgcagatcgatcacgtggttgccttgcagaacgcatggcaatccggggccaaggattggaacgcgagaaaacgcatgcagttcgcgaacgatccgtataatctgctcgccgtggatggcccggcgaaccaaggcaaaggctccgcctccgccgcatactggctgccgacaaacgcttcgtatcgctgcgattacgtggcccggcaaatcggtgtgaaagacaaatacggactctcggtgacgagcagcgagaagcgtgcgatgcaaagtgtgctgcatggatgcccggggcaggagattcccgccgattgagcgcactgcgaacgaatttcgcttggttgcaattgccgcctaaaacctgaagcagaacggcaacctgaagcagaacgacacagaagagtgaggtggtgggagcatggcggaacgggatgaaggcgcgacaggcagccaatcggcaatggtgagcggcgagccggtggtggacatcgacacggtggccgaggcggccgtggcggatcaggatgtcgcgatagcgcgcaaggattccggcaaaccggagaagcccatccatgcgctcgccagcatgctcggccccgcattcatcgccgcggtcgcctacgtggatccgggcaacgtggccgccaatctcacgtcgggggcgcaatatggctacctgctcgtctgggtgctcgtgctcgcgaactgtatggccgtgctcattcaataccaggcctcgaaactcggcattgtgaccggcaagagcctgccgcagattctcggtgaacgcatgggcagtgctggcagcttcctgttcttcgcgcaggccgaggtgattgcgatcgccaccgacttggccgaggtgatcggtggcgcgattgcactgaatctgctgtttggattgccgttgctcgtgggagggctcatcataggtgccgtctccaccgtgctgctgctgttccaaggagggaagacccataagattttcgaacgactggtgatcggcctactgctcgtaatcacgttcggcttcattgccggcctgttcatggatccgccgaatccgctcaaggtggccgaagggctcatcccgcggttcaacggaggcgcttcggtgctcatggctgcttcgatgctcggtgcgaccgtgatgccgcatgcgatctatttgcattccacgctggtgaacgaccactacgcgcataaggcgcataagcccagcatcaaggagatgctgcacggcagccgcattgatgtggtgtgggcgctcgcgcttgctggttcggtgaacatcgccctgctcgtgctggcggcgaattcgctgcacggcatgggtggcaccgacacgattgagggagcgcagcacacgatctcacaggtgctcggccctaccgtcggcacggtgttctcgattggactgctcgcctccagcctttcctcgacctcggtgggcacctatgcgggctcggagattatgaaggggttgctgcactggaacgtgccgatgtgggcgtgccgcatcacgacgcttgtgccggcgttggtggtgctcgccctgacctcgaaccccaccgaagcgttgatcataggtcaggtggtgctgtcgatcggcattccgtttgcggtgattcccttgatgcgatatacgcacaacaaacagatcatgggtaagtacgtggatggacccgtcaagcacgccatctgcctgttggtggttgccgtgatcatcgccctgaaccttgtgctcatcgtgctcaccctaatgggcaaagcctgaggaaagcgctgggtcggggatcccacgcttcgtcaaggtgaaatgctgccgcggtgcggcttcgccgcatgcggcgggcatcacgctcctcagcgagggatccccgacccagcgcttcccgtcacgtgtatttctgcctatttacccgtctcgatggtgcggagcttggcggtgtcatcggtatgggcgagggccttcgtgcccttgtcttcctgctctatcgagtcgtggtggagcgcgatgcggacggcttcgcgggccgagccggcatcttcacccttgacgccgaagacgaccatgagaatcatgatgaagttgatgacggcgctgatgcgcagtgcccattctatgccggtgatgttggcgggaatggtctgctgtccgttggacatgctggccgcagtgattgaatacatgatgagaatcatcaccggggagccgactgcgccggcgatctgacgcaccgtgttcgtgactgccgagccagcggagacttcggagggtttgaggcagttcaatgaccatgtggtcaccggcatcatgacgaagcccatgccgatctggcgaatgaactggtagaacgagatggaccagatccatgtatgcaacccgattgtgctcatgcacgcagtgcctgccgtaagcagaatcgtgccgatgagggccacggggcgcgcgccgaagcggtcgagtgcgcgtccgccgaagaactgcgagattgcctgggcaatggcgcccggcagcatgacgagtccgctgattgtggcgctgtagccgcggcaatcctgaatgaagagcggaatgagcacaatgagcgagctgaatgcgaagaagctcagcgatgcgatgattgtgccaatcgagaagctccggttgcgaagcaccgaaaggtcaagcagggcgggacggctgctcttgcctgccttgaacatcttctcggtgtggaactggcggagcacgaaccagatgatgcctgccaggccgatggccatgggcagccagaccaccggagcggagaacgggtaggcctgaatgttcgtgaaaccgaacatgaggccgccgaagccgatgatcgaaagacccaccgagaagaagtccgcatgcgcggatgtgtctgcctgcccgaaattatgcaggccgaaggtggtgagcacaatggcgagacagccaataatggtgagggtgaggaatatggagcgccagccattcagatcggtctgtacgccgccgagcgtggggccgatggccggagccacggccatcgccatgccgacgatgcccatcgccatgcctcgccgtgccagcgggaaaatggagaacacagtgatctgcagcaccggccacatcacgccggtgcccacggcctcaaggaagcggccgaagagcgccaacgggaacgacgggctgagccacgccagcaccgagccgagcgtgaacacgaccattgaggtgatgacgatctgccgtgtggagaaacggcgcgtgaggtacgcggtaagcggcaccatgacacccatcgtgagctggaaaatcgacgtcatccactgcccgagcgtcaccgagatatggaagtcgctcaccaaggtgggcagcgcggcgctcagctgcagctgcgtgaagttgccgacgaaagtgatgaacgtgagaatggccagcgagaggaacgcgggtcggctcaaatgcccgtcacggtatgcatcggtgcgcgtgagtgcctgggtgagtccggcgaagtagcccgaagcccgagggggagctggttctgtgtcgtgatgcacatcgcgggtgtatggtttgccggctgcggtcaccgtgttcccgccgcgttgctcgccctcctcgggtccctcgtggctggtcatcgcttgtgattccctgttctcttctgcatggttctgtgtgttctgccggcgcgcttggaatcgccgcggcggttattccgcggactgagcgtctgcttcggcatccgcttcgctttctgcggtgtcaagcgcggcgtcttccgggctgtactcgttcacggtgagaatggcagtgccttcggcggtgcgcacaaacacgttggccgagccgccgagctcctcaatgccgtcgagcagatgcgcgatcggctcggtgtcgagcatcggcagtacctgtgccacgccgttctcatcggtgatggaaagcgcggagtcgagttcgccggtcgaaagcatctcgttgacgcgctgttcaaatgcctcaagctcggtgtcggaatcgttggtgatcggtgagtcattgatggtggtcatgggtctcctcctttatctgacgaatggccgtatcggccgattcatgctgtacgtgtggcgaggttgatatacccggatgctcagattgtatatgagaacggtgtatatacaaccatctggttcctattctagaactggcctgtactattcactgctcgtgaacttagccggtgggccaggtcgctgattgtgcagtgtgagcattgcgatatgattgacatctgtattgagtcctgaataggtaagagccacggacggcatgtatgagggagagccatggcacaggcgaaaagcgatgctcagctcgctgaggaagtggacgtccgctccagcagggtgctgcgatggcgtttcgtcatgaacctggcactcatgctgttcgatgcgttggtctacttcgctaccagcatgattgtgctggtcgtatcgcatggcacgaatctagtgacgactcgtttgcaactgaatctgccgatagacccgtggctgtattccgctgcctgcgcggcgatttacgtctactgcatgcatgtggcgggggtgtaccaccggcatgtgttcgccgacggataccagctcaacatgttgctactcaagggtggcttcattgcctgggtggcgatttgcgcgctgaatttcatcattcagtgcaacatattcttctacatggtctgcctcacctcgttgattgtgtgggtggcggaaatgatcgttcgcttcatcgcgcgcgtcattctcaccagtaaacatcgcaaaggggagtattcgtacccgaccgtcatcgtcggttcccccgagggtattgggcagattctcaagttcctcaatcaacgcagacagctcaattacaagccaattcgcctgtgcccgattcgggtcaatagcgagacggggctcattgaggcggatccgaacaccgaattgctcagcaaggaagtgcatgagtcatggaattccccgattgatgtgattgaatatggaccccagctggctggacggattgcggaaaccggcgcacagacggtgatggtcaccgatgtgctcgaccgattctccgacaatctgagcacttttgctttgcagatggaatccgtgaatcttgagattgcgctgatcacctctgcgcttgacattgccgagcatgccacgcagatgcgcaacattcagggtatgagcatcatgacgatcagtctgcctcagtattccccctccgcacagattaagaaacgcgtgttcgatctcgtggtgtcgacgattgcgatcattctgagctcgccgatcatgctgatcgtggcgttggcgatcaagattgaagacggcggtccggtgttctataagcaggagcgtatcggcttgcgcggcaagccgttctatatccataagttccgttcgatgcgtgtggatgccgacgcacacctgaaagaggtattggctgcgcaagggcaggaattgggagcccggtacaagctcaagcacgacccgcgcatcacgaaggtgggtaacttcattcgcaagacgagtctcgacgagcttccgcagttcttcgatgtgtttatgggttcgatgagtgtggtggggccgcgcccgcaacgttcattcgaggtggccgagtatgacccggtctatgcgacacgtctgttggtcaagcccggcatcactggtccctggcaggtgtccggccgcaatgacctcaatgaggaggagagccgtcagcttgatgtgagttatgtgcaggactggagcgtcatgggtgatgtcgtgtacattctgcgcacgattggcacagtgctgcacccgagtggcgcttactagttaaaagtagttctaactaattacacgatcttgatatattttgaaacctgtgtagtaatttagagtatacttaagtgttgcagaggagaaaatatgtctgtttgcgggatcaccacctttaatcctgatttaaaacggttagaagcaaatttcaatgcaatccttcctcaagtgggtagtgtgcttgtttgggataacgggtcagacaattacaaagaagtgattgcactcgctgcctctttgagcgataagatacacattgctaccgagggcagcaacaaaggcgttgcttacgcgttgaatcgtctatgtgcttatgcccttgaaagagatgagagagatattctgctcctcgatcaggacagcgaggcatgtgagaacatgtacagtaacctgattagatataggacggataacgtagcaatcgtgtcaccaattatttccgacatcaatgtcagagtagatacaagcgatttaccagagaaggaagtgtgtctcctccctatcacatctggttcattaaccaacttggacgcatggaaagcaattggagggtttgacgaaaagctgttcattgatctagttgatacggagtatgatattcgagctttgatgaaggggtattgtagttatcgtatcaatacggtagttttgactcatgaaattgggcatatagaaccatctggattacctttcccaagaatacagcaagggaaaattgttattcggcggggtcataggagcgggcattcggttttccgcacttactatcaaattcgtaatctcctttatgtgcgagaaaaatacggctccttcctgaaaaggatgcacatccagcttcaatcacctcaatccgctattgtgcatacccttgtattcgacccaaatcgaattcagcgtgtgcgggcgattctgaaagctatcagagattcacgtactctgtttaataaattttgataagcaatctgtttgaatttataaatttttatgtatgaaggattataaaattatgactgtctctaataatgcttattctgctatttacgtggtttgtcctgcgtattcaaaaagtggtggcccagaattgcttcaccaattggtgcatgttcttaataataatggggtgaaggccataattgcttacacagcctataataaggaagataaactctctcctgtaaacgcagctttcaaaaaatatgtgaagaagtattgtttattcgaacagattcctgatagagctgattcgattgtcgtatttcccgaagtcaacatcgaagatattcattttctaaagaatgcgaccaagtattgctggtggttgagtgtagataattacctgaaaaggtataatttacattatataattaagaacaagttaactaggtattttcttacatggacaaagcatggtttttggcgctacgggttttcgtatatacgcaagaatgtaagtaagaatctcgttcaatcgtattatgccgaggattatctaaagaaacgcggttttacaaatatcgtatatctctccgactacattaatgaagaatatcaagaagatacttctatctcatatcgcaataatgcggtgttatataatccaaaaaaaggtattgaatttactaggcaattgattgaagctgctcctgatctgaactgggttccattggagaacatgagtaatgaagaagttcggggaaaattgaagacctccaaggtctatatagattttggagatcaccccggtaaagatagattccctcgtgaggcagcaatttcaggatgctgtgtgattaccgggaaaagaggatcggctgcatatgatgacgttccgattcccgaggaatatcagttcgaggattccgtcacgagtattcctgcgattgtggagacgatacgagaatgccttgtcgactatgatcgaaggatgcgtgactttgatgggtacaggtcaacgattaaggcagagaagaataaatttatagaagatgttcgttctatttttatgcattaagcgtgagagggatttctgttctgtagaatagcttaattggtgtatatatgagtaactcactggctaaaaactctatttttaatgtttgttaccagcttttgaatgttatatttccgctgatttctgcatcatatgtggcacgtgtacttatgccgtcgggcgtaggtttggtggcgatggcccagaattgggtagcgtattttgtgattttcgcatctctgggtatccccaactacgcgatacgtgaagttgcgcatgcgcgggattcgaaagctgggacaaagagagtatttacagagctcatctcaatcaatgcaatctccactactcttgcggcgattgcatactgtgccatgatcttcgtagttccaaatttcaaagagaacttggttctgtacattgtatgcggcggtagcatcctccttaattacattaatgttgattggatttatcaggggttagaagattatagctttatcgcggttcgcagttttattgtgaaacttgtttctcttgcagcgcttttcgtattcgtgcggagccaaaatgattatgtctggtatgcactaattggcgtgtgtgccatcgggcttaataatatattcaatgtcggacatttacataaacttaatattggtttaggattcagtaatattgaattgaaaaaacatatcaagccaattattttgattttctcaaccatcatttcgattaagttgtacacattacttgacgtgacaatattgggattgatgtccaataatgcagcagttgcatattacacaaatgctgataaaattattcgcatcatcattacagtgattactgcagtgggaggcgtgttgcttcctcgcatcagtcggtataaggtcgagaaacgctacgaagaatgtgcgagcatcgtaagtcgtgtgtttgaaattttgttcttctgctttctcccgattgggattggacttatatgcacctctagacaactggttcttattctcttcggagatgcctatagcgcaggcattcttactatgcaaattatgtcactactaatctatgcattagggtttagtaatttatttggcactcaggtactgctggcattcgaccaagagaaaaaactgctgtattgcactattggcggtgcattaatcaacattactctcaatctcgccttgattccgttgttgtcccagaatggcacggctgttgcatctgttgcgagtgagacttttgttacggcgaccacggcgtggttcgctagcaagactctgtccttcggcatacgaaagaatgtaatttggaaaacagttgtttcaacattgataatgacaataattgttgaagtattcaattttgttatcaaaaatgttttcttctcttttataacctgtgtgctcatgggaggagtatcattcctcttgtcgtcggtgatgctcaagaatccaattctgaattatatagtcaatgtgcttaggaggaggaaatagctcgaattcttagaatgtgttcatctcctgctaagtgagtggaataatcagattagttatttcagataattcaatatattaatgtaatagcatattaacaacataaaaaatggagctactatgaagattgccgttgctggaactggttatgtaggactgtcggttgcgttgttgctgtcgcagcataatgaggtgcatgcgctcgatatcgttcccgagaaggtcgaactgctcaacaattgccagagcccgattgtcgataccgagatcactcgtttcctcgatggcaagcgcgacggcacgatggatcttgattttcaggccacgctcgatccagctgttgcttacacgggagcggattacgctgtggtggccacgccaacgaactatgattcgaagaagaactacttcgatacctccagcgttgaggccgccatcaaggcgattcgtgaatatgacccggattgctggattgtcatcaagtcgacgattccggtaggctatacggctcagttgcgtgagaagacgggggataagaagattatcttctctcccgagttcctgcgagagggccatgcgctctacgacaacctccatccttcccgtattgttgtgggagctcctaccgatgatgcggaggcggtgaaagccgcccagaccttcgcgatgcttcttgcagaaggcgcggctccagaggaaaacgatcgactcaacgccgatggttccacaggcattccggaactggtgtgcggcacgactgaggccgaggcgatcaagctgttcgccaacacgtatctggcgcttcgtgtggcctatttcaatgagctcgacacctatgctgaaagccgtggtctgaacaccgccgagatcattcgcggcgtgtgcctcgacccgcgcatcggcacgcattacaacaacccatcgttcgggtatggcggctactgcctgccgaaggattcgaagcagctgctggccaattacgccgatgtgccgcagaatctcatcggggcgattgtcgaatcgaaccgcacgcgcaaggatttcatcgccgatcagattctctccaagctcgagggtgtggagaagccggttgtgggcatctatcgtctcacgatgaagtcgggttccgacaacttccgccagtcgagcatccagggcatcatgaagcgcatcaaggccaagggcatcgatgtgctcgtgtatgagccgacgctcgacgatgccgagttcttcggcagtgaagtgacgcatgatctcaatgccttcaagaatcgttccgacatcattgtggcgaaccgatggaatgagtcggatctcgccgatgccgccgacaaggtgtatacgcgcgatctcttccgccgtgactgataacacccaaggtgcttggatccttcctcggaaggccgagcacctttatacatggaaggcggctatgggaaagcttcacaatattcggacaaagctgaaacgataccgcaaggaatgcgtaagcgcatggcgcctgttcgggccaaagcttgccatggagggttatctggcacatacggtgggcataggcgtggaccggtactataccgatctatcacaggcaacatggtcgacattgatggaagaccttccatacagcatgtctattcctgccgttgatgaacagcaatgtgcgaatgcgccgatctgggtcatgtggtggcaaggagttgacaatcaggctccggacatcatccaggcgtgtgtgcgcagcattcgcaaacatgccaatgggcatccggttcacgttatttcgaagcagaatctacatgagtacgcatccatcgatgagagtgttgtgcaggctgcggaatgtggtgagattccgatggcggtgctctcggacatcatccgttgcacgctgctgtaccagcatggcggcgcgtggatcgatgccaccgtttacttgacggatgacataaaccctgaggtattcactcaccccatatactcgataccggtgcatcagaagaatcccacgagaaattggacttcgtatttcatcgccagcacccaaggcaatccgttattcgattacgcggggcgttcgctgacgcacctcgtcactcgggggaaaggaatccccgagtatttcatgctcgatgtcatgttgtcggtggcctatacacgtcatgctgaattcacagccatgattgatgccataccagcgaataacgaggggcgctttgcactgagtgagcaaatggattccactgaggcgcagccgcggattcctagcagtacctacataaacaaactgacctatcagattgattacccaaccacggtcaatggtaaggaaaccatctaccaacgtcttcttgatggtgaattctaaggtggaaggtgacatgtatgaaacctacgcaataccactgcgatttgagctgagctgaacgcaatcagcgtatgctgttaccattcctgtaggttcccggagctcggaatgaatagtgtaatggcgtatgagacgtgggaggaaacgagttggtggatggcgcaatctcggtcattgtacctacgctgaatgcgggcaggcagatcgacacgttgcttacacgactggagcaacagacgcgtaaacccgatgagatcattgttgtagactcctcgtctgaagacatcacacaggagatgatcaagcgccatcccgaggtgaaactgatcgtcatcgatcgcaagaatttcaatcacggtggtacgcgcgatgcgatgcttcgcgagagcactggtgatttcgtgctgttcctcacgcaggacgccatgccaagtggcaatgactatattgcgaagattgtggctccattcgcagacgatgaagtggcgctggtatatgggcgtcaacttccacgcaaggatgcgcgcccggcagaggcactcgttcgtaagtactcgtatggcgatgaatccatggtgatcaccaaggccgatattccgagcttgggcatcaaggccttccactctaccgatgtgtgtgcagcctatcgtcgtacggcatatctggaagtcggtggtttcgaaacagatgtgctgaccaacgaagatatgttcattgccgcacgctttctacatgcagggtggaagatcgtgtatgaagcgaacgccacggtgattcattctcacaacttcaccttcaagcagcagtacaaacgcaactacattcagggcgtggagattgccaagcacaaagacattcttggcgatgcgtcattgtctggcgaaggattctccttggtcaagtacacgcttggcggtttgctcaggcaagggcatgtgattgaagcaatgcgattcaccgttgattgcggattccgtctcatcggcaatcgcaatggtcagagggctgccgccaaatctcatggcaggaaggagtgataaagtgtctgtttcctccgagacgatcatgtatatcgtaagtcacaaggattttgatgcaccccagcttcctgggtatgttcccattcttgcaggggcggtcaagaaccatgcctccattgaggtaaaagacaataccggcgataacatctctgccaagaatccggggttctgcgagctcaccgcgcagtattgggtgtggaagaaccgtgatgaccgtgacgcgaacatcggctttgtgcactaccgccggtatttctacatcgaccatcggaaagcgcagattgttccggccgaacaattctcgcgcgacctcgaacaatacgatgtggtgctccccgaaccttgggtgctcagaaagaccataggagaccagttcgcccagttccacaacctggatgatctggaggtcgtgcgctcgatcatgcaggagcaatgtccggagtatgtgccggcgctcgatgaactgctgaagagccattcgctgcatgcctacaacatgttcgtcatgtcgggtgaacggttcgacgcctatatgacgtggttgttccgtattctcgacgaggccgagcgccgcatcgatgtgtcgaagtatgacgcatacaatcagcggctcttcggattcctttccgagcgtctgctcaacgtatgggtgaacgcgcgcaagctgcgggtcaaggaatacccggtatacatgcccgagcagagtgcgcggaaggagaatctgcgcacgcgtgtaaaatcgctgctgttcgaacacaagctgtagagagggtaccgtatgcgttgcgcagggatagtcacctataatcccgatctcgaacggttgcgcgcgaacctgaataacaccgccagccaagtggatgcggtgttcgtcttcgacaatggatcggagaacgtcgcggatatccgctcgcttgcggactcggaatatacgaccctgagggtcgaagccgacccgaataacaggggcatagcctttgcgttgaacaggttgttggatgccgccaaggagcatgggttcaagcatatgctgctgctcgatcaagacagcgtacccacggaaggcatgtgcgacgagttggaacggcacctcaccggttccgtggcgttggtatgcccattcatactcgaccgcaaccgcatgaccgaggaggagtggcaagcgcagaagatgccgccgttggagcggctgacccatgctgccaagcatggcgcgatcacttcgggttccttggtcgatgttgcagcggccttagaggttggtggcttcgatgacaacttgttcatcgattacgtggacttcgatttcaatgagcgcctgatattgaacggctatgagattgtcaaagacaacaccgtctatctgttgcacgagaagggcaaatccgagcgtacctggctgaaggtgcctcgcaacacgtcggcgggtgtgcaatggcagccgctgtataagctcggatattcgccaatgcgttgctactaccagtcacgcaaccgcattgtgtattggaagaaataccataggcacaccggtggcgaggggcttacggaaattccgttgctcatggcgttgtcattgctgttcgagaaccatcgcattgcaaaactgcgcgcctattcgcggggcattcacgatggcatgaagatgaagattgtggagtataggaagtgacagacaccaccgaaaccgttcaacggcaggcggaatatagcccgcgaattcgtgaggtggtgaacgcgttgatggattacgcgcttgttctcgccatcatctacaactcgaattcgttgtgggcgcttgcgggtgataatttctcgctctcgtgcttcgtgttgctcgccgtgtgcatggcgtatatgctgtgttgttggcgcgaggcgcggcaccgtctgcatcgcgtggggtctgcgatgctcgtgctcgtgctggccaccgtcattgggcagttggtaatggcggtgtctcatgggggatcggggtacacgaacggcacctggttccaatatgcgctcatcgtacctgcattgatggggtgcatgctcatgcgtggccacgaatatgtgcgtaaggtgctgctcaaccgtttggtggtggtggcggcggtattcgccgccatatcagtggtgctatgggcggccagctccttccttctgctgcccccctcgcacgtcgagcgattgagttgggtgcataatgtaccaccgatctattcgtacgcagatgtgtactacaatgtgcaggatgctcatgtgctgggcatgacggtgtggagaaactcgtcgattttcaatgaaccaccctgcgctgtggctttttacggtatggtactcgccatcgacttgtatataggcaagaaagtgcactggggcgccgatctctgcattatcggcgcacttgtcacatccctgtccactgggggtgcgctctacgtgttggtgctgttggtgccgttgctatggaaggccatgcttcacgtacagcgcagaggattgcgctatgcgttgctcagtgttgcggctctggtgtccatcgctgccgtggtcgcaggcacgcgcattgtaatctccaaaatggccacgtcctattccggccaaacccacttgcttgatttcactgaaggcttccgtatttggtggcagcgcccgctgacgggattcggattcgattccgacgagtacatctggacgcattatatgagcgcctaccgcgatggcatgggatataccagtggtttgctgttcctgctcatccatggtggattagtgctggcgctttatatgatcgtgccatttgtgctgctggtgctaggttcccatgattggcacatgtggtatttcgccggattcgtgatgatcgtgttcatcactgcgccggtacagaattgcgcgttcctgttgctcgtggccgcgtacggctatgccagcttcatttggcgttacagtagacgtatgagcagtctgccattggtggctcgtacgccattgacccatgaggggagtgaggggcatgcctgagatctcggtgatcattccggtatataaccaggaagaatacgtaggcgcatgcatggattcgctcctcgaccagagtttcgaggatttcgaggtgctggccgtcaatgacggttccaccgatgcctccgtctccattctcgagggctacgagcagcgtgatggtcgtgttcagctcattgatcagaacaattccggcgtatccgtggcccgtaacaatggactgtctcatgccaaaggcgaatgggtgtgcttcatcgatccggatgattatgtggctcctgactatctcgacaccctgctgaaagccaccgaacgtaatacggatatcgccatgagcacctgcgtggcattcgatgaccagcgttccgccaggcagcatttcttccctgaatccttcacggcccgtgccgctgatgagaaggtggaactgttccgtcaattgatggatggttcatatgcacagcccaaaggattcgtcacggccattggagtgccgtggggcaaactgtacaggcacgctttcctgcaggagcatggactgcagttcgacgcagcattgcctcgcatgcaagacaatctgttcaatatgcaggctttccaactggcgcacgagattgtgtatgtggattatgcagggtattactaccgtatgggcggattgagcgcgcgcacctacaaaaacaatgccaggggtctataccatccggccattgacgagcgtgcccgactcatgcgtgagtaccatctcgatggcgatgcgacgttgcttcgggcttggaacgaggagcaggtgaacctgtatttccaggaactgaaggcggtcatcatgctcgccgacccccaatccgtcaagcaggcggctcggactcgtgcacaggcattggggccacgattggatcagattgatgtttccgcattgagccctgcaattcgattcaaatacacgatgatgcgaaatgctacgttgtgttcgcttctggtacgtgccttgcgtgccaagggctgataccgctgaaggagattcatgactgctgcaaaattcggattcgtggtgctgcattatcttgcgggagatgccacggcaggttgcatcgaatccatcaaaacgcattgccctcaagctgtcatcgtggtggtggacaataactcggccaatggtagctacgaggagctgcaacgcaagtatggtgctgattccaccgtgacattgctgcataacgcagtgaatgaagggttcgcccgcggcaataataccgggtatgaatatgcgcggaatcgcctgcattgcgatttcatcgtcacgatgaacaacgatgccaccatttcctgcgatgatttcatggagctgtgcgaggaggatttcaaggcgcatcctgatgtgggggtgattggtccggacatcgtttcgggcaagaacggttcgcactcgaacccgatttattcgatcatcgacacccgcgcggaggtggatcgtcagatatggcgcttcaaggtgattctgcttctgctgcaccttcacctgttcggcccgctgacccgactcaaggcaaaactcacgcattccgatgccaatgcattgcccgagcatgtcaatgccacggcagatgccattaccggcaaaccttacaagctccatggtgcgtgctttgtatttacaccggcattcgtcaagcagttcagctgcgcattcgactccggaactttcctctattttgaggaagacattctgttgatgcgatgccgagcccggcacctgacgatgtggtacgacaagcgcatccgggtagatcatatggaggatgtctccaccgaccagatgatgaggaaagatgagcgtaggaagatgatcttcacgctgcataactatgtgcgttcattgaaggtactgaaacagtacgtcaactcaaaataatccaagtagataattgaggatatacatgggcaggcagctgaaacagccaaagatacgctcagtgaaattcaacgtggtcatgaatacaatcctgaccacttccaccttcctattccctctgatcacggtgccgtatgtatcccgcgtgctggggcccgacaacaacggcatcgtttcctgggcgtttactttcgtagggtatttctctcttgtggctttgctgggtttcaatatgtatggcacccgagagtgtgcaaagcttcgagacgatcgcgagaaactgagcgtggtggttcaggagctgcttgtcattctgatatgttccacaactgttgtgtacgtcgcattcgttgtactggtgtttttgctgccccgcacccatgacgaacttcccctcatgttcattgtgggcacctcgatatggctttccgcatgcggcgcggaatggttctatcgatccatcgaacaatacgagtacatcacagtacgaaatattctcttcaaaatagcgagcattgtgctgctgtttgttttcgtacgtcaaaccaacgattatctggcctatgctgcagttaccgtacttggtacaacgggctcgaatgttctgaatattcttcggctacgttcattcgtcactttttcacgaaaatatgagatgaacatccggcgtcatttcaaacccatgttcgcgttcagcatttccagcatcacgtcgggcatgtatggccagatagacatgttgttgcttggttttttcagctcgaactatgcgctgggtttgtatcagctggtattcaagattcgtaacatgtgcactggtgtcggaggatcggtcactggcgtcatgctgccgagactctcatactacgaggcgcaggaggggcatgatcagacgaccaagttgatggcgaagaatttcaatttcctcttgatgttgggattggccataatttccgccttggtcatttgcgccgatccgctgatcatgattcttgggggcaatgactatcttcccggcaatgctgcattgaaaatcggcgcaccacttgtgctgcttgggtcaattggttccatgcaatcgcaatacatggtcgcttccgatcaggaaaaggtctatacgtataccaatgtggctggtcttgtgattgccattgttctggaatgcatcttcattcctttgtggggcattaatggtgctgcacttggacttgtgcttacggagctgtccgtctattgcattcgcacctatattcttcgtgacttcatgcggaaagtccgtaaatataccgattattggaagattgcttttgcgtgggcggtggcatccatagtgaccgctggcatatgttatgcgatgcgtgggtggaacccatttgtgcagatcatcatcgcagcgctggtgttttgcgtcgctgatggcggcttgcttgtacttgtcaaggaatcgttcatcatgtcaatggtgaggaaacgctagactacaacgcacgtatggtcgctagttggacgattctatccatgaacttgttcggccagaattcgtatgcgaacagtgtgtgtgtgcgttgacgttttgtcatctgaggcaaagcgcagtactggtcaaggattatgagattccgagtctgctgaagatcagacaaggcatcacgtatataggtcgcctgatccaacatgtggttcatatgcgtgacgcgttgcctgcgaatcgaattgcgatggattacgagactcatgaacgttttcaatgccgagtaactgtgcgctcccatcgcattgtccccatgttgcctatagttcacggttgcttcgtccacatataccacatgccccaacgtggctgcgatgagggcgtagcaccaatcatgcatgatcatacgattggcgttttcgggatcccaagattgaatgacgttcagtagagctgtattcattgcgcttgcacaacctgtgacgagattctgtgcaagaagctcattgagctgtgtccgatgagggttgcgcccgatgaatcgcaggaatgatggtgcaataacatgattgtttgcatctaccaccacaagatcggaaaaggcgaggataggtgcattcttcccataccgtgcctcagcgttatgcatgcgttgcatgaatagttccagcttgtttgtatgccagatgtcatcttggtccgccagaaacacgtattgacctgatgcctgactcatgagaaaagtgaaattggcttgtggagaaccatacttcactccctgtgaaacgatgttgattcgggtatcgtgattcgccattcgctgaagaatgccaagcgttccatcggaggagcagtcgtcggagatgctaagtttccaattgggcacagactgctgctgaatggattcaatctgttgctcaatatattccgcgccgttataggtagccatgagaatttcaatttcaggttgcatggatgactactttcctcatgagatgtttcggttttcaagatactcctataaggagaaagcatggattagacatgtgcccaatatgctgctgaatccgatcgataccacagtgaagctgggtgttctgatagttggtagttgctaaactgatgcctatgactgacgcattcattccgaagaacatcattgtaaccggtggctgcggtttcatcggctcgaatttcgtgcattacgtgtacaacaatcacccggatgtgcatatcacggtgctcgatgcacttacgtatgcaggcaacctcgagaacatcaagccgatcctcggcgatcgtgtcgagttcgtacatggcaacatctgcgatgcgcagctgcttgacgaactggtgccggggcatgatgccatcgtgcattatgcggccgagtcgcataacgacaactcgattgcaaatccggaaccgtttgtgaaaacgaacgtcgagggcacattccgcctgcttgaagcggcgcgcaagtatgatgtgcggttccatcacatcagcaccgacgaggtgtatggcgacctggctctggatgatccagcgaagttcaccgaggaaacgccgtaccatccgtcaagcccgtattcatcgacgaaggcgagctccgacatgctcgtgcgcgcctggcaccgcacctatgggttgcgcaccacgatctcgaactgctcgaacaactatggcccgtaccagcatgtggagaagttcattccgcgccagatcacgaatatcatcgaaggcattcgcccgaagctctatggcgatggtctcaatgtacgtgactggattcacaccgaagatcattcgagcgcggtgtggacgattctgaccactggccgtttgggtgagacctacctgatcggcgccaacggtgaacgcaacaacctgaccgtgctgcacgacattctgcgcgtgatgggtcagccggaggacgccttcgactgggtgaaggaccgcccgggccacgaccgcaggtatgccatcgattcgacgaagctgcagaccgagctgggttggcgtccgacgcacaccgacttcgagtccggcctgcgtcagaccgtgcaatggtacatcgacaacccgcagtggtgggagccggcgaaagccgccaccgaggccaagtacaaggcccagggccagtgaatgctttgaatccgccgcaactcggcggattcatcatgtacagacatgcaacagtgatgtggaaagcgtgaactatggaatttgaaaaggaactcaaggtcacggagacgaatattcccggcctgttggtcttcgatttgccggtgcacggcgataaccgcggctggttcaaagagaactggcagaaggcgaagatgacggcactcggcttgccgaaggacttccagccggtacagaacaatgtcagtttcaatgcgaaacgcggtgtgacccgtggcatccacgccgagccatgggacaagttcatctcgctggccaccggcgagatcttcggtgcctgggtggatctgcgtccgggtgacaccttcgggcaggtgtatacgacgcgccttgacccgtcgaaggcgatatatgtgccgcgcggggtgggcaacagcttccaggcgttggaggatggcacggcctacacgtatttggtgaacgcgcattggtctctcgaacagaagaagacatacaccttcgtgaacctggccgacccggaactcaacatccaatggccgattccgcttgagcaggccgaactctccgaagcggacctgcatcacccgatgctcaaggatgccaagccaatggatccgaagcgcacattggtcaccggtgcgaacggccagcttgggcagtcgattcgcaagtatgttgaagagcatgatctcaaaggattcgaattcaccgacatcgacgaattcgatttttcggatcctgccgcctatgaggggtatgactggagcctgtacggcacgatcatcaatgctggggcattcacggcggtggacaaggccgagacgcccgaagggcgtgtgacggcgtggaaggccaacgcacttggcccggcgctgctggcgaaagtggccaccgagcacaatctgaccctcgtgcatgtaagctccgactatgtgttcgatggtaccgccaaggtgcacgacgaagatgaggcattctcgccgcttggcgtatatggccagacgaaagctgccggcgacatcgccgtcgccaacgccccgaagcactacatcgtgcgctcgagttgggtcatcggcaatgggcataatttcgtcaagacgatgatgatgctctcgaacaaggtgtctgatccgaatgatgcattgaatgaggtgacggtggtggatgaccaatatggccgtctgacgttcaccgatgacatggcagctgccatattccatctgctcgatgatgaggatccgtatggcacgtatgatctcactggttccggtgacgtggtgagctgggcacagattgccgccgaggtgttcgccatgacgaatggcaatggagacaaggtgcgtccgatctccaccgagcagtacttcgagagcgcgaaggctccggtgagcccacggccgacgaatagcacgctcgatttggccaagatcgaggagaccggctatgagaccaccgattggcatgacagtctcaaggcctatgtcgaagtcgaactgaagaagtgaggatgggttccagatgaaaggcattattcttgccggcggttccggcactcgcctgtacccgctgacgacggtcacctccaagcagttgttgccggtgtacgacaagccgatgatcttctacccattgagtgcgctgatgatggcgggaatccgagacatcctgattatctcgacgccgaaggatctaccgaatttcgagcgcctgcttggcgatggctcccgatacggcatctcgttgcagtacaaggttcagccaagcccggacggtctggctcaggccttcctgctcggtgaggacttcatcggtgacgatgcatgcgccctcgtgctcggcgacaacatcttctacggcaacggtttgggccgccaactgcgcaaggcagccgcgctcgaacatggcgccacggtgttcggctactacgtcgatgacccggaacgctacggtgtcgttgagttcgacaaggagcacaaggcagtgagcattgtggagaaacccgagcaccctgcatcgaactatgcggtgaccggactgtatttctatgacaaccgcgtggtcgacttcgccaagcaggtcaaaccatcacctcgaggcgaactggagatcacagacctgaaccgcatgtaccttgacgatggttcattgcacgtgcagacgctcggccgaggctatgcatggctcgacaccggcaccatggactcgttgttcgaagccggcgagttcgtgcgcacggtggagcatgcacagggtctgccgatttcggtgatcgaggagattgcctacgagaaccgctggatcgaccgtgaccagctgcttgccgccgccgaacggtatggcaagagcccgtacggcaagcacctgctcgacgttgccgaacaccggttcctcagcaccatcgacgattgatgcatcgacagcgcaggggatgtatgtgcgaaaggttcgttccggaaagtgttccgagcgaacctttcgcgcttcttgtactgcagcacccctattcttgaaagacattgatttggatcccgatccggtacgaaagggtgggcatgtcccgaacagaaggcaatgaacccgagattgagaagagcatcgatcagtctgcggagtctgcaggaaccgcaccgcaatccgaaccggcagcctcacaggagcgggaggtcgccgctccaaagcgcccgtggtacaagcgtatccgatggtggggctggacactcatcggcatctttgcagtgctcgttgcattttttggcacttttggcgtgcaggcaatgatggtgaagaattacgagctcggctccatcgacaccatcaggcgcaccgcgatgagcggcaatgtgaaggaactgccgaacgccgtctcgaagatgcaggaaaacaccagaaaagccaaccgcatcacgcacaacggcctatggaatttcattggatcatggccgggcatgggcagcaacatcggtgcagcgcaagatctgacccagattgttgcggatgtaagccaagatgtggtgcccaaatacatagatatcgcgtccaacattatgtcggacaagctgttcagtaacggtcaggtcaatatcaaacccgtcaccgcgcaatacgtgaatttcgtcgaggccaacagtgatctgatgagccagctcgcacgcatcaacgacattccggaaccatcgatcggcgtggtccgtaatctggtcaacatggccaagggatatgtggggacagccgatgggctgctcaagcaggcggaaaccattatgcaggatctgccgagctatctggggtacaaggagccccaaacttatgcggtcatggcaatgacacctgcggagatgcgtatgtccggcggccttatcggggccatcggtacgctgactctcaacaaaggcaagattgagattggtgaattccttcccaatgacgcgtatgtcaaggaaggaggtgcagatgtggatttcgacaccaaacgcattttcatgaatgacggaccgttgtatatgacgtatgacgtacgtgatctggccaacttcaccgacaccgaaatgacggcgaatgcgttcctctcgctgtggaagagaatgccatggggcgagaagaccacactcaacggcatcattatggttgatccggtggtggtgcaggctctcgtgaaagtcaccggtgacgtgaaactgccggatggcactgtgctcaatggcaataacaccgcccaattcatgatgaatacggtatacaccgaacatgagccggaggagacgaacgcctacttcggcatcgtggcgaaggcctgcgtgggcacgttgatgaagcatatggatatgaagacgattggttcactcgccaaagatctgcgcacattggccaaagaacgccatctggcgatgtactcattcacgccatcgttggaggacctcatcaaggccgccggattctccgccacgttgcccaccgacaaggtgaaccccacattgggcgtctacctcaccgaacagaacccatccaagatgggttggtatatcaagcgttccacgaagatcaagcagatctgcaccgactctgcaccctacaaatatcaggtggagtacacgttggagaacacgctcaaggaagacgaggtgggcaagctcagctggtacatcaccggccagttcccctacaatgagggtgccagcctcgataaggtgttcttctacccgccgtatggcggtgaattgagcaatttcaaggtgcagggaaccggttcggttccggccatggattcattcaacgcggcgatcatgtaccgttcgctggcacaggtgaggccggaacagaaggtgacctacaccttcgatgtaacgacgtcgaaacaggcggcgagtcgtcttgccgtcgaccagacgccaatgggcaccgagaacacgaatgtggagtacctcaattcgtgtccagtcaattgatgggtggacgtactgcagaggtactacattggagaccgcatcactagaaaccgtatgacgaacggaaagacgcgacgatgaccactcaccagacgaccgcagtactcataccgtgcctaaatgaggagcagacgatagggaaggtggtggcagacttccgtcgcgaattgccggatgccgttatctacgtgtacgacaacgccagtgacgaccgcacctcacaggtagctgctgatgcgggtgcgatcgtgcgtatggctcctgaacgaggaaagggcaatgtgctgcgcagaatgctgcgtgacatcgatgcggaccggtatgtgctggtggacggtgacgacacctacccggccgaagacgtgcacaccttgttggacacgctcgaccaaggctgggacatggtggtcggcgacagactttcctcgacctatttcaccgaaaataaacgcccattccacaataccggcaaccgcttggtccgctccgcgatcaatagcaccttccacgcgcagattcgcgatgtgatgagcgggtatcgtgtgttcgacaatctgtttgcaaaggcgtacggggtcatgtccaatggtttcgaaatcgagacggagatgaccattttcgcactggatcgcaagctgcgtgtgacggaggtgccaattcagtaccgggatcggccggagggcagcaccagcaagctgagcacgttctccgatggtgcgaaggtgctcaacctcattttccgcttggcctatgagaaccgcccgttgccgttcttcggcacattgggaggcatcattggcggtgttgggcttggcttggcgctgtgggtgtgcattgaattcgcacagaccggcatggtacgaagattcccgctgctgattggatccaccatgctgatgatcatcggagtcattgcggtgttcaccggtttggtgctcgcggtgttcgcccgcaaggatcgttcgcgtttcgccttcgcggcacagacctacatcgcggcatctggtcgtcatccaagcgtcagcgagccctaccgtgcatgcgttgacgaggtctcgcatgagcccgtcactgatggacagtgacgagatccttggttccggtcttgtagcggtagatgaaggggattaccaatagaggcagaatcggataatagtagcgtacctgcaggccatccaatctgagactttcggagggaagcgtccaggtgagcaggaacgggatgtacatgaggaatagtgtggcaaacacaatgaatccgacaagtgtgtaaacctgcatggtggtgcgccgaggaacggcgatgcgggcgtcctggccgaacatccatgcaatgagcaaaagaatgaggcagacgattaacgtgggattgctctgtaccatgttgaatgtggtcaggaacacattggctagaatccggaacgtggttccaaagggattatgcagtgccgcgttgaaattataggcatataggccttccacgcgttctgggttgtatccgaagaatttctgccagcacagcactgtggcgccgacaaccagaacggtcgatgctgtgtaccacactttctgctttccagacagtgctttgcacgcaagccatggcagcagaatgattggtatgtacacgtatttgaggaagcatatcaggcaggtgcctacagtgagcgctgcaacctgccagttgttcagacggcgttcgcgttgcatgagacgtacgcataccgctatgaacaaggcgactgcggcgaatagtgtgccgtctgtcatcaaagtgcttgaacagaacacaggtaacggcagcatgcccagcagtgcgatgatgccttttgctgtgggaatcacagcgatggcgagcaggaacaacagcagataacaaaccagattcgaagcccgggcgtagttgatgcaggtacttgggttggcatgggtgaggaagccgaatttcatgccgatggcttgcggaatgtaggcgaagaacatgtactggttactgcgcgtgggtgttgtgatgatacgttccccctcggcaagattgttcagtctgtcgcactgcgtggcatactcgtcgtttctggtgagatcgaatgggttgatcgattccaccagagcgtttttcgccccattcacgctgccttggagatatcgtgcttctcctgtgagcaattgtctgccgccgaccggcatgctgctgggaacctccgaagtgcgtgggtcatattgccggtgggactctggtgcccgtgtgatattgaacgactgaccggtggccaatgcataggtcgatggaagatgcatgtcgggatccgccatggtcagtggcgccgttgtggtgatgaacgcaatgccttcgaccatggagatgatgaggaacaaggccatcatcttccagctttcgcgcagtcccttgccaatgagttcggggaatggtgaagaaaccttgtccgtatgccgatggcgttgtgctgactgcattgttttctcggaatccccgttggttgcctccatatgagtctcctttcttcgtggatttccagcagccgacggttcgtcatctgccctgggaacggtcctcttccttatcgtgccgtaacaaatggactccaccccggatcatggggcgtcgaatgtagtggaattatgccacccgtgccacgagtctagcgtggttgatggtcaatgtgtctcctccttcgtgcaggtgcagcatgcgtggtatatggcgttatggatttcacggattagggttgactcggaaaattctaaaagactcctgtaaatcaggcattctttttaccgaaatatgtgaaatcaggcaataatctctactgaagatgctatattgagcatgtatcgctgtgacatacggtctcagtttgttacgaaataatccgtctgtcgacgtaaggaagtttgtatatgtcgtctctgcaaggattcgaagtagtcagcccgaacacggcctccggtcgttccgtactcacagtcacgaagaactacgctcggttgaacaagaacgccgtgcttgaacttgggcgccctgaattcattgagttcttcatcaacccgaccaccaagcagttcgcgttcaaggcatgcgaggaaagcaacccgaatgcgattccgttcttcattccaggcaagaccaccgcttcggtgacgctgaaccagcagttcgtgcttgacgcaatggggccgtatttcgagttccccgaagtcgaggacgatcaggaggcttacgcacagatcaagggcacgctgctgaactccgaggatatgctggtgttcaatgcggcgaaggccgagcagggtgtgatgaagaagcgtggtcgtaagaaaggccagaaggtgaaggtctccgaggcctgaaccaatctagcccctatctattacaacggtcgccgttcgcggtggccgtttttgtttgccgtgatatcccgatgcccatttccgagcctcgacaagtatatatgtgtaacacttgccaatgcgagttcaatgtacattcttcgcgagttattcggtataaatagtgtcctattgactgaatatactagataaggctttgcttggcggaggagcggaagggaatacggtgcgtgatacatctcggtggactgcaggctcctcaatgcaaacgcaggaaatacgtatagtcacaggccatgagcagaatcaccgtgctgagtcgaaagaatcgacgcgccagcagttgccgtatgagccgatcacgttctacaacacctcgtttgaggaatccggcaagaaaagagccaatcacctgtgcaacgcgcctcgctggcgcttcctcttcatatttaccattgcggtggttgatgtcatctcgatgctgatcgccgtggtgggcgtactgttggtcaatcgcgaggcatacaccacgattgagcggtacatgccggtctgggcgttcattgtgctgtactgcattgtgtggctcacctgtttggtgtggcgcggtacgtaccacaggcacatcatggcagagggatatgagctctatgtggaggtgctcaacgccacgatagccaccattgtggtgttctgcttcatcgtgttcatgctgcatttggattaccctcgcaccattcttcttgtcgcaccaatcttcggcatggtgttggcacttttcggcaggctcttccttcgcctgatgctccataggaagcgcgaagagggtgaatacaagtacaatacggtgattatcggttcctccgcaggcattaatagcgtgctcaaactcttcgatgccaacaggaattgggggtatcgcgccgtcgccatatgccccattgagaaagtgccggatcgtgacgatgcctacattatgaccgattttgtgccggaagagggcatcgccgagaaatacgctgtgcagacggtgccgttgaactccaacttccctcgcaaactgcagcagatcggcgtgcaggaggttttcgtggccgatgtgctcgaccgtgattccaaactgctgcatggcattgcactggccattgaatccttgggcatggagcttgcgctatcggtggcattggccgatgtcgcaggccataggctgtacctgcacaacaccaccgaacagccgattctactggctagcctgccgcaataccgtgccacgacattcctgttgaagcgcattttcgacattgtgctgtcgtcgttagcgctcatcatctcgtcgccaatcatgctcggcgtggccatcgccatcaaactggacgacggtggtccgatcttcttcaaacagacccgcatcggtttgcatggacgcagattccagatgtacaagttccgttccatggtgacgaacgccgaggaagtcaagaaaaagctgatgcaggagaccggccagaccgatcgcttcattttcaagatgaaggacgatccacgcatcacacgggtaggccgcttcatccgacgtacgtcactcgacgaattcccgcagttcctcaatgtgctcaaaggcgatatgtccatggtgggcccgcgcccggcactgcccgaggaggtggcgcgctatggttcgctctattcggcccgtctgctcgtgaaaccgggcatcaccggtccatggcaaatctccgggcgctccgacctcaccgaggagcaaagcgagtaccttgatgtctcgtacatcgagaactggtcgatcaccggcgacatcgcgattctgatcaagacggtgtgggtggtcatccgcggtacgggcgcctactagttggatacgtatgtttgatggggctctaggtgttgtgtgacactaagagcccccatctttttcctagccatatccataattgctacctgtagccaatcggctgttacaggagagcattccataataccgggaaataagtgggatcttgggaatcgtggaggcgtttatcgtctcccataagagatttaatggcggcctttgttgccgcaacaaaaagggtggttcatccatgttggatgaaccaccctgaatagtgccgggaaaccggtctgcggtttagtaccagtggttcgcctgccagaagttgtaggcgccctgcacggagccgtaacggcccttgcagtagtcccagaaccatttgagctgcgtctggtagttcgactgccagtcggcgccgtgcgaggccatcttgctgcccggcagcgcctgagcgaggccgtaggcaccggagctcgggttcgtggcgttcacgttccagccggattcacggctgatgatgtacacggtggcggtgaagtcgccttccgaaccgccgttggcaagcaggtagtcatgcgcccactgctgcatctcgcccacaggcgcggtggagccgatgctcgaggctgccgcctgctgcgacgagttgttcgcattggtattcgagttattgctggtctgcgccggggccgaggtggcggcgggctgcggattccctgtgcccacgagcaccaccttctcgaccggggccttcttcacccaggtggcgaaggtgttcgacgagaccaccttgtcgccggtgcgggtgaccagattcgtcttttcgagaatgccttcctcgccctcggtctgcaccttctcggtgcccttcggcagtgacgggtcgtctttcttcaccgtgttgaatgggatcttcgattccgtggtctccatcttcgcgccctggcgttcgatggagatcgtggtggattcgtccaccttcgtggtgagcgacgggttcacctgatcgcccggctccaacgtgatgtcgccggcgtcgagcacagacttcacgtcggtgaagtcctggccgagcacgacgcgggacttgccgttcaccttgacggtgacgtacgaggtgtcgccgtccatggcctcgcgggcgttgccacgggaggccgcatgattgctctcggtgatggaatatgcggttgcgctgggcgttggctgcgcctcggcacgcgaatacatgctttgggttgcgactactccggccactacaagacccaccgacgccatcgcagtggaaatgcgaatccactgccgtttgctcaacgagcgcagcgtaggtgcgttgtgcttgctatggtgtgccattcttctcctaaagtctgcggataatgccgatgccaagacgccgacttcgttaacgagcgtcttctgtgtgcggctgccaaaccgggcgtctcaaacacatgctgggcagaagtatacgcgcaccgttgcagtttttccacgcagagggcaatatgtcacccagttctcacattcggccgatagagaaacacaatacttctgcgagattgctgcgatgcgctggcatgcggattgaacattgcgcaaatgaaaaggcggcacatgtcgtgcatgtgtcgccttggcggaatgactgccgaatcaggcgtcatgctcttcgatcagctcgtcctggtcggtgcctgcggccttggccgctgcgagcgcagcctcgacgtcgagcgccttggcctggccgatgagatcgttcaggtcggcttcgcgcagtgcgccggcctcctggtagatcacatggcccttcttcacgatcatgagcgtggggacggcctgcacgttggctgcgttggcgagttcctggttcttgtcgatgtcgatcttgccgaagaagatgtcggggttctcgtccgccaccttgtcgaagatcgggctgaacgccttgcacgggccgcaccaggttgcgaagaaatcgaacagcgcgatctcgttgcccttcactgcctgttcgaaatctgcggaagtgagttccttaactgccatatctagctccttaaagtctgtcggggcgtttcttggcgtcccttattcacgtacaaccccatgtttagcaattcattccgtgagtttcctgcaatacgccacgaggtaaatatgtcggcgtgccggattctgcctgccggcgtgcgttcgttgcttgcgcgcgtcataataggggtatgcgagtcttgaatgatgaagtgcccgatgacggcgatttcgacgccggacgctcccgcggcgagttcgaccacatcacgcccgaagacatcacgcgtggcacgggcaaccctcccggctggctcggtgccgacgacattgccgatctgcgttcgcgcatgcccattgcgtatgtggagatcgtgcccgtgcgcgtcgatgatttcggccgcgtcacgcagattggctccctgctgcgcgtggcgaacgaccagtcgattgtggagcgcacgctgatcgctggccgcgtgctgtatcacgagtcgttgcgtgaggcgattgcccgcaacatttcgaaggacatgggcgagctcgcattgccggtgctgccgcagacgttgacaccgttcacggtggccgagttcttcccgaccccgggagtctcgccgtacttcgacgcgcgccagcatgcgattgcgctgtgctatgtggtgccgatcgccggtgactgcaagccgcaggatgagacgctcgacgtggagtgggtggatccgcatggcccgcagattaccgagttcattgagcagatgaacgatgggcatggcacgattgtgcgccaggcgctcgcgtgggtgaatctgtgagcagactggtggatttctgggtgtttacgcttaacagtcgtttgacagtatgaaatgaaaccgagtgagggagatgggtatggcggacgaccatgcaagggaattgccggtgattgcaaaccatgtgattcgtgagggcaacggcattccgttggtgctggtgcatggcttcccggtggacagccgcatgtgggggcgttgtgcgatggcgctcatggagctgagcgatgccgatgagctcgtgcagtacccgatctgggcgccggatatgccgggtgcgggcgagagtccggtgccgactgcggcacagagcgggcgtgagaacgaggacggctcgttgccggacggcttggatcgcatcgctgacgcctacgtggccctgctcaacgacgccgggtacacgcaggcgatctgggccggcctgtcgatgggcggctatgtggtgctcggcattcaacgccgtcaccctcaggcggtggccggcatcgcgttgctcgacacgaagggcgacgcggacagtgatcaggcgcatgcctcgcgcatcgccattgcgaaggaatgcgtggaacggcagaccaccgaaccggtgatgttcttcgtggacgtgcatgaaggcgattcgagcgtgaagaaatccgccgcgtacattgaccagttctcgcaatggattcgcgagcagcagcctgacggtgtcgcctggcgtgaacgcatggcggccgcacgccccgacctgaacgacgaattcgcgaagatcacggcgccggctgcggtgatctgcggcgaggaggacccgtcgagcgctcccgccgtgatgagacccctcgccgaacgcatggtgaacacgacggtggtgatgaccgaaatagaggattgcgggcacttcagcgcatgggaacgccctgagacggtggcccgcgcattgcatgaactcgtttcgagggtgccggccgccgccggagccgaccctgctgccgccgacgcggccattgcagccagggaggcctgatgttcgcaccactcgcattgacgcaggcattgccctacctgcccttggcccaaggcgacatcgactaccaggtggaacggcgagcggacccgcagctcatcgagcaggtgctccaaatgccctccacctgtgtgctgctgtgccgcaagggcaaggtggccgtgccattcgggcagcacaacatggcgcaattggccgcctcccgcatgcgtttggcaaccttgcccggctcgtatgtggcacgggcgctcgaacacggcaacaacggtgtggtggccatgtatctgggccgctacaaaggcgcgcacgatgagcatgccattgcgttggacctgacggctgtggaggagggcgaggagctgcgtcgcgtggaggagcgcgcggcagcggccgggcacgccgtcgacgcggccttcggcgacgacgtggatgcgcgcgaatctgcagacagcaacgccgtgaacatgttcgagcaggcggtggaacggttcgactgggtcgacctgcgcatgttcgcgccgcacgccagctcacgtgagatagggcaggcggtcacgatgctctcgctcgccaactggcacgacatgcaacggcattgcccacactgcggcgcacccaccgaaccggcgatgtcgggttgggcgcaacgctgcacaagcgagtcggacgaccaccgcatactgttcccccgagtcgaaccggcggtgatctgcaccgtggtcgatgcgaaggaccgcctgctgttgcagcacaaccgcgcgtggaaacacagcaatctgttctccgtgtcggcagggttcgtggagaccggcgagaacctcgaacacgcatgcaggcgcgaaacgatggaggagaccggcatacgcgtgggcgaggtgaaatacctcggctcgcagccctggccgttcccgttctcgctgatgatggggttcaaggcgcaggcgctgagcaacgacatccacgtggacggcgacgagacgatcgccgcacgatgggtgacgcgcgacgaatacacgaatctgctcgtcaccggcgagatcgaagcgcccggcaaggcgacgatcgcacgcgttatgatcgaggaatggtacgggcgcgaactggactgagcgcgcggaacacaggacagccgaatacggaatcggacagcacgaacgatacaaggagagaatatggcagaggagaacgaacagggcacgcatctcgacgtgccggacttcctgcagtactcgcatgaccacgtgtgggtggacgaatcggtcacgccggcggtgctcggcatcaccgaattcgcggcgaacaagatgggcgacatcgtgttcgtcgacctgcccgaggtgggcatgcgcgtggaggcgggcgacgagctcgtgcagattgaatccgcgaaggccgtcgagccgatgatctcgccggtggccggcgtggtgcgctacgtgaacagcgagaccgaggacgacggtgcggtcatcaacgacgacccgtacggcgaggggtggatcgtcaaaatcgagctcgatgacgacgaaccggatctgctgtcggccggcgaatacgcgaaattcattgcccagcagcagtagaatacgggtatcgcaggcatatatacgaaacaatcaacggaaaatgcgttagagacatggcatatacggacaggtcggaccgcgagctcaggaagaccaagcgtctgcttgaggcggcactcgcacaggtgaaacgcgaacaggccgagcgcgcacgcctcgccgcggacggcgacggtagcacggttgcgacgcaaggtcgcacggtgagatccggcgaagggcctacggacgccgacttcgacgacacgcagcatgcaggctccgccgagacgcgcgtcatcaccggcattgcgaacgggcaggcggaaaccgagaccccggaacggcaatggcgggcgccggcggtggcgttgcgcacgacgtccgcagccacgtccacagacgacatgccgaccgtggccgtgccgctcggctcgctctccgcggcgaaagcgccggcggggagaacgcggctgaggaggaatccgaaactcgtctcatcgatcaagcgagtgctgcgcaaggcgatcacttggacgttcggcctgtggatacggttctccacggccatcgcaaagcagctgcattggttccccatggtcaagccatacgtgggctacggcacggaggaatactcgcgactggtttgccgtactatcctcgcgccggcagacggacagccgaacaagccgatgcgcggcatccacgcgatgctcgaagtgcccgcgcccggccaatgcgtgcagatcgacatcgacggtgtgccgctgcgaaccgtgcaggtgggcacgatggaggtctacaacccggtcgattccgcacggtcggtgacgatggattactcggtttcggattcggcaggctacctcgacttgctcgccgagcacaggctcgagccgggcgtgcacatggtcagctgcaaggtgacgcgtcgtccggcggtagaggcggagctgttcacgataccgagcacggcgaaggtgggcgtgatctccgacgtcgacgacacctgtatggtcacgcaggtgcccacattgtggaaagccgtgtacaacatgctgttcctgagcccgcacaagcgcgcgtcggtgccaggcatggcggtcatgtacaacaagatcgcgagcatgttcccgggggcgccgttcttctatctgtccacctcgccgtggaatgtggagaattcgattcgtaactttctgaaggattatggattccccgacggtccgctgctgttgcgcgacctcgacccacggccgaagaccttcgtaccctccggcgtgcagcacaagctcgaatacgccgagcagctcatggaggacttccccgacatgaagttcattctgatcggcgacgacgggcagaaagacccgaccacctacgccgagatcgctcgccgctacccggggcgtgtgctcgccataggcatacgccagctctcgcccaaggaatccggcggattcggcacaatgtcgggcttctccaccacgcagcctgtgccggtgaccgacgtgccggtgttcacgggcaccaccggttcgaacatcatgaagacgatgttgccgtacctgcggcagttcatgtgagtccgagcctcctctgcggcagccgaccctttttacgcagtgaaacaactgaacggaagaaatccgcattgaacagaagaaatctgcgtaaaaagagacagatagggcgcgtaaatgtctctttttacgcagaaagtggggcgtaaaagggacaggtggaagtctgcggatgtccctttttacgcaagggagggtgcgcaggtataatctttggcctaatgactggtatgcatgttttcccgaagccgccggaggcgaagcaggttccctccgtgcgcacgttccacggcgacaccttcaccgacccctacgagtggatgcgagataaagattccgcagacctcaaatcgtatgtggccgccgagaacgcctacacctccgcgcgcacggccggcttggccaatctgcgcaagacgctattcgacgagttccgctcgcatgtgcaggagaccgacatgtcggtgcccacgcgactggacggctactggtactacgcacgcacgcaggagggcaagcagtacggcgtgcagtgccgcatgccgatccgcggcgaggacgattggacgccgcccgagattaatgccaacgatgcgccgggcgtgatccccggcgaacaggtgatcctcgacgccaacacagaggccgagggccacgatttcttccagatcggcggcatggacatctcgaaggacggcacatggctgctgttcggcgtcgacacgtccggcgacgaacagtatgacttccgcattcgcaacctcgacaccggcgaacagttgcccgacgagctcgacgggctggctgcggcgtgcttcacgcccgatggccgctatgtgttcgccacgctgctcgacgacgcgcagcgcccatatgcgattcgccggcacaaggtgggcgagccggtcgaacgcgacgtgattgtgtacgaggaacacgacgagaaattctgggtgggcatagggctctccttcgatgagcggaatctggtgatcggcaccggttcgaaaacgaccaccgaggtgctcatgctgcccactgcgacgccggagggggagttccaggcgttcattccgcggcaggagggcgtcgagtacgacgtgagcttcgccgtgttcgaacatgcgggcgagcatggcgaggatctgccggttgcaatcgtctaccacaatctcgccaacccgaatttcgagatcgatgtcatcgacatgagcgccgcccgcccgccctaccgcattggcgatggcgtgcgcattgtgcagggttcgccgtacggcagcgaggacggcgagaaggtgatcgccggcgcgtccgcaatgccggtgggcacgccgtacgacgatgccacgaatccgcagattctgcgcggcgtgcgcgggctcgcggtggagggcatcgcgatgcacgagcatttcgtggcgctctcgtaccgcgcgaacggactgcccaagctcgcggtgatgtcgaaacagcaggccgcacaggacttcctcgcgcgccgcccctggcaattcgccgaggtgaacgtgcctgagctcgatggggattgggacggcgcctcggacgacgctgcggtgaatccgccgcaactcaaggatttcgaaggctcctcggcgcgcctgtattcgatcggcaccgccggcaacccgagctacgaggcgccgcgcatgcgctacatggtgacgggctacacgcggccgggcgaactgcgcgagttcgacccgcgcaccggtgaggacgtgctgctcaaacgcgcgaacgtgctggggagtttcgacgcgcgcgactatgtggagcgacgcatctgggtgcaggtgcgcgacggcgagcaggtgcccgtctcgctcgtctggcgacgcgattgcgtgcgcgggcgcatgccgatgttcgtgatcggctacggcgcctacgaaatcagttcggacccggcgttctcggtgtcgcgactgagcatgctcgaccgcggcgtgctctacgtggtgccgcatgtgcgcggcggcggcgaaatgggccgcgcatggtacgagatggggcgcagacgcaacaagaagcacacgtttgaagatttcatagacgtcactgcggccatacaggactgcgggctcgccgaccgtgcgcgcacggtggcgaacggcggctccgcgggcggcctgctgatgggtgccgtggcgaacatggcgccggaacgattcgccggcatcgaggcggatgtgccgtttgtggatgcactgacgacgattctcgacccgacgttgccgctcacggtgaccgagtgggatgagtggggcgacccgttgcacgatgcggagacctaccgctacatgaagacgtacacgccatacgagaacgcgccggcgccgggcgagggcggcgcgcggtggccggacggcacgccggtgacggcgttcccgaagatcttcgtgaccacgtcgatgaacgactcgcgtgtgatggtggtggagccgctcaaatgggtggcgcggctgcaggccgcgggtctggacgcgatcatcaagatcgaggccgaggccggtcacggcggcaccagcgggcgctacgcgcagtggaagcagatctgctacgagaacgcgtgggtgcttgccgccatgggcatcgaagagtgagaagagcggtgccggttcgcgtcggcgccgactgctccggagtaatcccaggaataatctcaccactaatctcaccgtcaatctcactatgcgaaacgttcgcgccgaaacgtccaagaactgaaaaccgcgcgaaagcggcgagtgcgagcgggtagtctgcccatatgactcaaaacgcaaagcagtacacgatcgccgtcattcccggcgacggcattggcaaggaagtgaccccgtgggcacagcaggcgctcgaaaaagccaccgagggagtggcgaccttcgagtacgaaccgttcgacctgggggcggagcggtatctgcgtgacggcgagattctgccggacgaagatctcgaacgcatcaagagcaccgacgcgattctgctcggtgcggtgggcgacccgcgcatcaaggcgggaattctcgaacgcggcttgctgctcaagctgaggttcgcgctcgaccagtatgtgaatctgcgcccgtcgaagctgtacccgggggtcgagtcgccgctggcgaacccgggcgagatcgattttgtggtggtgcgcgagggcaccgaaggcctctactgcggtgccggcggtgcgatccgccgcggcaccgagcacgaggtggccaccgaggtctccatcaacacggcgtacggcgtcgaacgcgtggtgcgctacgccttcgagctggcgatgaagcgccgcaagcacgtcacgctcgtgcacaagaagaacgtgctcgtcaacgccggcgacatgtggcagaacatcgtgaacaaggtggccgccgaataccccgaggtccagcatgactattcgcacatcgacgcggccacgatctacctggtcaccgatccgtcgcgcttcgacgtgattctcaccgacaatctgttcggcgacattctcactgacgaggcgggcgcggtcgtgggcggcgtgggttattcggcgtccggctgcatcaacgcgagcaacgaatacccgtccatgttcgagccgatccacggttctgcccccgacatcgcaggccagggcatcgcgaacccgaccgccgcgatcctctccgccgccatgctgctgcgtcatctcggattcgacgacgccgccgcgaaaatcgacgccgccgtggaactcgacatcgccgaaaacggcagccggcaacgctccaccgacgaagtgggccgcgacatcttggctcgcctgtagactatggcaacgtcaagccgatcgattcggccataggaagcgccgcgtgaacgcgcggcaggaaaagaggacattatgtgctgcaactgcaacgaagaagctccattcaactacagcaacggtttccagacctacgcgcgcccgacctcgggcccgtacatcgccacgacgcacattccgtcggagtacggcccggtctacgtcgactgagctggtcgaattcggccatttcggcctgaaaccggttgcggggctatacgcaacacaaatctcacggaaaggtctgccttcgggtcggccttttcgcatacccgggcaggtgagcgtgccgaaatcggcagggcgcgcaaatcaggccgccgggaaggtgcgctcattggccatttctcgcgcacgcggccaaattggccaacgaggatggctgctcgtgggtctttttgcgcgggcggtggcgtattgaccaatgagagcccgctgatgccgcattgtgctgtggagatatcttcacatgcgaggaacgtgtatgctgagctgtaccaaacacacggtgatacacagtgacattcgtataaggagacaatatgagtgatccgaacggttaccagccacagggcggcgaccagcagaacaacggcgtgtcaggtgccgcacaggcaccccagtacacgcagcccgcgcagaattacgccgcgccgcagtacacgcagtcgcagggcggctacaacgggcagtaccaggacccgaatgcctacgcgcagcagaactacacctacgcccagccaccggccgcgtacccgacctaccttccgcgcaacaagtatgtggcggcggcgctcgcgctgttcttcggcatcttcggcctgcataacttctacctgggctacaccggcaaaggcgtggcacaggtgctcatctcggtgctgaccttcggcattggggccattgccgtgatgatctgggcgattgtggaggcgattcagattctcaccgcggactacggcaccgagcaccaccgtgatgcgcgcggtgtcgagcttcaggattagcggcgacttcgacgcattgcattctgcggggggtggttccactggactgcgccccgcattgcgtatatttgcgaataccaaggcgggtgagatcgaatgagatccggcgaagtgaagattcctggcggcaaactcgtgcgggtgaccttgcagggcgacgaggtgcgcggttggcatgcgacaatcgacggcgatttcttcatggaggccaacgctggttcggtgttggggcgtgcgcaatccgcaatcgacgcgcatctgccggaactgcccgatgattgggagcactgggggagcgcggattacctcgcgttctacagggcgctgtccggcgaattgcgcggcgtgatcggcgacacgctgatcggcgccaacggcgaggcgatcgcattggccgtcgtgcgtgcgctggtgggcggcggtgcgcgcgaatccgcgcagacagccgaacgcgaattcgagcgtattcgcgaggcgcgcgcaacacggcagggtgagcgggcgcaatctggggacgaacctgcgcccatgctcatcgggctgcaggacgcgaaacggcgatgggcgcggatgaatccgcagaccgtcgtcgacattccacgcatgcccgccgagcagatgcaggtggacgaactatgggccacgcaggtcgcgaacggggagcggcaggcgacgctgagaatctgggattgggcggcgcccgcggtggtctgcgggaaattccagtcgatcgccgacgaggtggacttggaatacgccaaagagcacggcattgaagtggtgcggcgtgacaccggcggcggcgcgatgttcatagaaccgcagaacacgatcacctattcgctctacgtgcccgagccggtggtggcggggctcgacgcgcggcaatgctaccagttctgcgatatgtggctgctggaggcgctcgccgcatgcggtgtgcgcgcgcatttcgccggcctcaacgacattgcgagcgcggcgggcaagataggcggcgcggcggaacgtcggttcccggcaagcggggaggggcccggttgcctgctgcaccacgacacgctggcatatgcgatgaacaccgagcatttgcagcatgtgctgcgcccgtcgaaggagaagatgtcggacaaggcagtgaaatcggcgagcaaacgcgtcgacccgatgaactcgcagacgtcgtgcacgcgcgcgcagattgtcgattgcatgctcgagacggcctcccgtttcggtgtcgtggggaatacaatatgaacggcagtgcttttcgatagatacctttggaggaacggcatgaatcagtccgccgagcggatgccaagcggtgcgatgtctgacgaaccggccggcatgggcgacgcacgcgagcgacgcaatccgctgctggagaccgcgttgttcaagcaggtctccgaggagcaggcgcgcgagctcgtgccttacctgcaccatgaggagtacgacaagggcgagtacatcttcaccgagggtgacaccgaccagcgcatgtatgtgatccaggaggggcgcgtgaagctgacacggcagtctgtggacaagcgcgtgcagctgctctcgatacatacccgcggcgaactgctcggcgagattcccgtgtttgacccgcaaggcggcccgcgcacggcgaacgcggtggcgatggtggacggcacccaggtggtgtggctcgaccatgacgcattgttcgcgtggctcagcaaatacccgggcgtggccgtcgacatgctgcaggtgctcgcgaatcgcatgcgcgccaataacgagcgcattgccgacttggtgttcagcgatgtgcccggccgtttggcgaaaacactgctgagcctcgcctcgcgcttcggcaagccggtggaggaagggctgcaggtgccgcatgacctcacccaggaggagatggcgcagctcgtcggttcctcgcgcgagaccgtgaacaaggcgctcatggattttgcgaaccggggctggattgcacgcaacggccgcactataatcatctaccagccgggagctctcatccgccgttcccagcggtaggcatgcggtttcgggcagtcgatatgccaatctgagtgtcgtctgaaagcaggctggcattcgtttgtatatttttcgaacatactgtaaaattcgcgctccggtagagccagacccatagaatagagacatgccgaagaagaagaacctcactggcgctcgtatacttgcgctcgcacttgccttcatcacgctgtgccttggcggcggcgtgacgttggccgtgctcttcctgcccaccgtgatgggggcgaatcaggttgtgaaggccgtgacgccgtcgatgcaggttgagggcatcgatttcgacgtgacgaatctgccgcagaagtcgacgatgtacgcgagcgacggcaagaccgtgatcgcggagttctatgcgcagaatcgtgaggtcgtgcctttgaaggacatctccaagccgatgatgcaggccgtggtggcgcgtgaggaccgccgcttctgggagcatgcgggcgtcgatgtgcagggcgtgctgcgtgcgttcgtgcagacatatatgaagaagggcgatcagcagggcggctcctcgctcacgcagcagtatgtgaagaacgtgctcgccacgcaggcgcgcgagaaggacgatccgatcgccgaataccatgcgaccgaggacacgatcgcgcgcaagatgcgcgagatgctgatctcggtgcagatggagaagaagtattcgaaacaggagattctgcagggctacctgaacatcgcgcagttcggcacgaattcgctgtatggcgtgcaggccgcggcggagcggtatttcaatacgaccgccgacaagctcaacatcgtgcaggcggcgacgatcgcgatgatcacaaagaacccgtcgaagtacgatccgtcgattccggagaaccgggaggaggcgcagaagcagcgcaacatcgtgctcgagctgatgaagaaccagcatttcatcacgcaggccgagtacgaggaggccgtgaagaccccgctggtggacacgctgcatatcacgccagtgtcgcgcggttgcatggcggcgaagtacaacacgggcttcttctgcgattacgtggtgcacaggatcgagaactcgccggagttcggcaagaccgcgaaggaccgtgagcggctgctgcaggagggtggtctgcagattgtcaccacgctcgacctcgacgcgagcaatgcgttgatggacgtggcgaacaagacgattcccgcgaacgattccagcggcatggagatcgtgatggcctcggtcaagcccggcaccggcgaagtgctcggcttcgggctcaaccgcgcctacgacgcgaccgatgccgcggccaccgaccagacgaagtcgtcgatgaactacgcggtcgatcagatcgacggcggcggccagggcttcccgatcggctcctcgtggaagccgatcaacctcgtcgcctggatgcagcagggacgctcggtcaacgagatgctcgtcgcaccgaccgacttcctcacgaaccgcttcacctgcaacggctacacgggcggcaccgacaactggcacgtgacgaacgcgttgaccaatggcacggtgtcgccggaaagcccgttcctcggcctggtgcactcgcataacacgacgatggccgcgatgggtgcgcagatcggtctgtgcgcggtggcggacgccgccaaggccgtgggctaccacaatgcgaagatcggacaggaggacgtctattccgacatctcgatgcacccggcgctgctcatcggcggcaccacgtcggtatcgccgctcacgatggccaacgtgtacgcgacgtatgcggccaacggcgtggagtgcacgccgatcgcgctcaagaaggtcacgaactccgacggcaaggacctcgacgtgccgaaggccaactgccaccaggcggtggacaaagacatcattcagacgctggcctatacgatgaaccagggcgtgacacggcccgacggcgcggcaggtgcggcccagctcgcgaacgggcgcaagaccttcgcgaagaccggtacgaacgagaacatgtacgtgaccaccggcggcttcattccgaaccagatcgccaccttcgtgctcgtcggcgacgtgcaggacccgacgaaccacccgattgagaacattgccatcaacggcaactaccacggctactgggatggttccaccatcgccgcacctgcgttcaaggatgcgatgaaccaatacgccgacaagaagcagctgccgatggacaacgattacggacaacccgtcgacaagtacacgaatagcgttggcgtgcaaagcaataggcaaggcacacagcagaacacgcaacggcggtgattcgctcggcgtgaatagcacgatgggctcggggcaactcgggcccatcgtgctattcggatgctggcggtctgtttttcggatgcttccgtaagctgtgccatggtgggtgcgatttgtggtctgttttacggaagcttccgtaaattggactgtggagggtgcaatctgtggtctgtttttcggatgattccgcaaactatgccatggagtgcgcagtttgcggtccgttctgcggatgcttccgtgaactgtgccgcttgctgcaatgggaatgtgatactctgcgcgtatgggcaagtctaaggattccaagaaggtcaaggcgcagcagccgactctgttcacgccgttcacactgcgtggcatcaccgcgcgcaaccgcatctggatgccgccgatggacacatattccgcgttcgctctcgacgggcgcccaggcaacttccactaccagcactatgtctcgcgagccatgggcggctttggcctgatcattgtcgaggcgaccgcggtgactcccgacggccgcatctcgccgtgtgatctgggcctatgggaggattcgcagatcgattcataccggtggattgcgcagggaatgaaggacgctggtgctgtgccggcgattcagctcaatcatgccggacgcaagggctcgacgagttgtttcgccattcgcaccgactccggttatgtgtcgcccgagttgggtggttggcagacggttgcgccgagcgagttgccatttggcgacttgcctgcaccgcgccagcttacggtggatgagatccacgacattgtgaacagattccgcgatgccgcatggcgcgcgatggaggccggtttcgaggtgattgagattcatgccgcgcatggctacctgctgtcggagttcctcgacccgctcgtcaatgaccgcgacgacgaatacggtggttcgcttgagaaccgcatacgcattgtgatcgaggttgccgatgcgattcgctcggtgatccgcggcgacatgccgttgtttgcgcgcatctccgcaaccgactgggccgagggcggctgggatctcgaccagagcatcgtgttggcgaaggcgctcaaggagcatggcgtcgatctggtggacgtctcgaccggcggcattctgccgaatgtgacgattccgacgaagcccgggtatcaggtgccgttctcggagcagattcgcaagaaggccgatgttccggtgaccgcggtcggattgatcaccaagcccaagcaggccgcgcgcattctggccaaaggcgaggcggatgcggtggagattggccgcgccgcattgcgcgagccgtactggccgttgcgtgccggcttcaagcttggtgagccgaccgacctgttgccatacccgccacagtacgtgcgtggcgcatggcgtaatgagtaatggccctcgttgtcgcaagagacatcccgtaacagggaaagcccgttacgggatgtcagaggccgtggggaagagggacggcaaaaagccgaggacggaaagtggaatagtatgtggtcggttgggcctgccggttgatttcgtcactggatcgcaagcgtcctttacgttcctcagccaatcggcagacccaaccgaccacgctggtaccgatgaaggtgcatgctgttcgctgaacaatcattccatgggtcatccgagtaccccatcccgcggccagcggaagctgaaggacaaatcaggcgtcgacgcccacggcctcggcgacgcttccgaagccgtcacggcgcagcagtttcgcgagtcctcgcttcaatacggtgatctgctgcgggccgcggtacatgagcgacgagatgaacatgatgagcgaggaaccggcgcgaatcttctcataggcctgttcgggggtgaacacgccgccgacgccggcgattgcgaaccggtcgccatactcggcataggttctgcgaatgagctcggtgctcgccactgtgcaggggccgccggagagtcctccgagccaatccttggggatgtcgtcgagaccggtgcggtctttctgcagattcgcgatggtcacgccctgcacgttgtgcgcggccaatacgtcgaggaattccttgaactgcggccacggcttgttgagcggcatcttgacgagcgtgggctgcgggcgttcgattctgtcgagcgcggcgaacagcttgtcgagattctcggcggactcggtgaacggctcgcccacggtggtgttcgggcaggagacgttcacctcgaccatcgcggtgcggccggcggcacgctccatggagatgcagtagtcttcgatgccttcgttcagatcgcccacctggtcgtcgttcgtgcgtgcgatcgacacgctcagctgcatgctctgcgtgcgccgccaggcatcttcggcgcgttcgatcacgacgtcggaaccatcgttggccaggcccacgtgcaccatcatcgaatcgtattcgggcagacggtggaaccaggggcgtggattgccggcgcagggtcgtgaagtggtggagccgaccgtctcgaagccgaaaccggcatggtcgagcacggcggccatgtcgcagttcttgtcgaggccggccgacaggccgaacgggttggcgaagttgatgcccatcacattcgtttcgagaatcgggtcggtgtagttgagcatcgtgcggcacagccacatgagcggcggcatcttgccggtgatctggcagaagcggatcatttggtcgtgggcgatgtcgggcgtgtggttgaacacgagatccggcttgatcacatgcttgtatgcgaacgtgaacaggtcggtggtcgccttgttgatcgagtcgtgcagaccgttctgagatacataagccatgcacaccattgtgccattgatggggcaaaaatgcatgcctgcatgcacccgccccgcatttcgcccgcttcgtgcgaattcgcgctctgcgagagagtgctggggaaacggcgtatgcctacaatgaagacggtcgaataacggatgctcgaatgacgggagggcgtgcggatggcgcaggtgaacagcgggcaccgtgtgtgcgtggtgatgcccacctacaatgaacgtgacaatctggagcccacgctcaccgacctctttctgcgcaatgccggcgtggatgtgctgatcgtggacgacaactcgcccgacggcaccggcacgctcgccgacgtaatctcgcgcgtgacgcggctgccgcaggatctcaacgtggagcataacgagaacgatgtactgcgcgatgtgagttttgcagatgaggattccgattcctcgctgtattccgacacgcaggtgagcacccaggatctgaagatcgccgacagactggcctcgtgcacgatggattcgcgcgtctttgtgctgcaccgccccggcaagcagggattgggcaccgcgtacattcagggattcgaatgggcgcttggccataggtacgacatcgtgtgcgagatggacatggacggctcgcacaggccgcaggatctgcgagcaatcatcgacgtgctcgagcggcacccgcaggtggatctggtgcttggctcccggcgcgttcccggtggctccacgcaggactggccatggtaccgcgacgtgatctcgcgtgccggttcgcagtacgcgcgcgtgatgctcgggctcaaggtgcgcgatatgacgagcggtttccgcgcatatcgctccaggattctgcggcagatcgacctcgacggcatcgatgcgaacggctacgtgttccagatcgatatgacgcgccgcgtgatcgccgccggcgggcatgtggtggaggtgccgatcgtgtttccggatcgcacgaagggcgactcgaagatggatggctccattgtgcgcgaggcgatgcgtaaggtgacgcagtggggcttcacgcgcatgcagcagacgattctgcacaacaacgagcggatggaacggcaggtcgaggacgatctggagctgcctgggcagctgatgcgtgaggatgcgggcctggctcaggatgatcccgagcaatccgaggagtatatggaacgcgagtagcggtgcgccgcgcggcgtgggcgagggaatccgcaattctgcgatatatgcggttttgttcggtgttgtgtggtaaacacgccgaaatgttcgtttcaagttgttctttggaagaagatgtgcgataatgttcgcatgatttcttcacagcgtcagcatctgattctggggcgcctgcgtacgcgcggcgccgtccgcatcaccgcgttatcgaaggagttcggcgtctcggcgatgacgattcgccgtgacatcgccgaactggccgacaaaggactgttgaggcgcgtgcacggcggcgcggtctccaccagcacgctgctgagcgagccgctgttctcggtgaaatcgcagatggacatcggcctgaaggatgcgattgcgggcgaggcgatcaaattcgtctcaccgggagacgtcatcgcgatcggcggcggcaccaccgcgtacgtgttcgcgcagcatctgctcgaatcgcccaacgcgaacggcatcacgatcctgacgaattcgattccggtggccgagctcgtgcaggcgctggaatcgaaggacgtcgaggtgatcgtcaccggcggcgtgatcactcgttcgaattcgctcgtcggcccgatcgccgacaaggtgatcgcctcgctgcgtgtgaacacggtgttcctcggcacgcattcggtctcgatgccacgcggcttcctcatgccgaactcgctcgaagcggcgaccgacatggcgatgatggacattgcggaccgtacgatcatcctcaccgaccacacgaagtggagcagcacatcgttgtcgctgttcgccaaattcgaccaggtggacacggtgatcaccgacgacggtctcgacccggattccgttgcaaagacccgcgatctggtgaaggagcttgtgctcgcccatcagatcgaaaccgaagaggaaagtgagtgatgacaccgatgtcacagacacccaaccagcccgaattcgcgcattaccagcccggcgaatacgccgcggaacatctgcgcatcacgccgaccacgctgtcggacggccgtgatttcttctacctcgacgacgagccggagtatgtgaacggcagcaggacgcgcgtgctcgacgacccgcgcgacctggactaccgcttcgcaccgcacttgaacgccgagggtgtggaagtgaagtacgcggcaccgcagatgcgccgcgacccgctcaccggagactggattcccatggccacggcacgcatgaacaggcctattactgcaggcgcgggcgcgacggcgaaaggcaatcctctggcggcgcgcaagccgggcgacccgtatcaggacggcgaggtgcccgacacggattacgacgtcgtggtgttcgaaaaccgcttcccgtcgatggtgcaggtgccgggagtgccgaacgaggtgcgctatgtggacggcaacccgctgtggcaggagcgtccggcggccggccgttgcgaggtgatctgcttcgactccgacgagaacgggctgccggcggaccttccggtggaacgtctgcgcacggtggtggaggcatgggccttccgcacggccgagctgagcgcgatcgacggcatcgagcaggtgttcccgttcgagaaccacggcgaggagatcggcgtctcgctcgcccacccacacggccagatctacgcgtacccgttcatcgcgccgaagctggagaccgagctgcagcatacgcaggcgtatttcgagcgcaccggcggcaatctgctgcgtgacctgatgcacgccgagatcgatgcgggggagcgcgtgatcatgcgcaaccacagctgggtggcttatgtgccggcggccgcacgatggccgctcgaggtgcatgtgcagccgctgcgcgacgggattctcacgctcgaccagctcaacgacgccgagcgctgggatctcgcgcagatgtactcgacgctgctcaggcgcggcaaccgcttcttcgacaagggcgacggcaagggcatggacctgccgtacatcgccgcatggcaccaggcccccgtgcgagacgcacgccgcgagaactaccggctgaacctgcagttcttctcgttccgccgcgccgcgaacaagatcaagtacctcgccggctcggagtcgggcatggccgcatgggtctccgacaccacgcccgagctcatcgcacagcgattccacgagctcggccccgtcgacatcgccgactgaccgcgcagcgcaacgcatatcaattcatacatttggaatccgaagtacttgttgaaagggctttccatgacatcagtcgaattcatcgagccaatgagcgacgccgagggcgccgcacgggccgccgaactgttcaagcaggcctacggcaaggagcccgcaggcgtgtgggccgcaccggggcgcgtgaatctgatcggcgagcacaccgactacaacgcgggcctctgcctgccgatcgcactgccgcaccgcacctatatagcgctctcgccgcgtgacgacaccagcgtgcgcgttgtttccgacctcgcctccgatgtgattgccgaggccgacctcgacgggcttgaagccggtggcgtggacggttgggccgcctacccggtgggtgtggcctgggcattgcgcaatgccggtttcgacggcgtgcagggtttcgatgcggcattcagctcgtgcgtgccgctcggttccggcctgagctcgtcggccgcgatgacctgctccaccgctcttgcgctcgacgacgtgtattcacagggcttcggcgataccgacgaaggccgtgtgaccttgatcaacgcggcgattgcctccgagaacgacatggcgggcgcctccaccggtggccttgaccagaacgcgtcgatgcgctgcacccccgaccatgcaatccgtttggattgccgacctggcctgagcgcggtggacagcgtgcagcaggaggtcttcgacctcgaaggccacggccttgagctgctcgtgcttgacacgcgcgcgccgcaccagctcaacgacggacagtatgcccagcggcgtgcgacctgcgaggaggccgcgcgcattctgggcgtcgcgaatctgcgcgaggtggcagatctggtgaatgcgcaggcggatcctgccgccgcgctcgacggcgtgctcgaccgactcgacgacgagaccatgaggaagcgcgtgcgtcacgtggtcaccgagatcggccgtgtggacgatttcgtgcgcgctttcgcggaaggtgacatgcagaccgccggcgaactgttcaacgcatcgcacgactcgctgcgcgacgattacgaggtgaccgtgcccgagctcgacgtggccgtggatgtcgcccgcgacgagggtgcgctcggtgcccgcatgaccggaggcggattcggcggttcgatcatcgcgctcgtgaacgcgggtgaatctcagcgcattgcgcaggcgatctgcgatgagttcgagcgccgcggattcgttttgccgcgcgccttgcccgcgcaggcgtccgcctcggcgcaccgcgtgcagtgatctgctcgcagatgccctctcgacaagccgccgtgcccagcatggcggcttgtgtgtcgtcatggggcagggaagtgaaaagggtctgcaagcattcgccatatcagtcgcctccgccgccggtattcgatacactaggctcagagcgaaacagcgagggagcatatggcgagaacaccgaagaacggcaacgatatgcaggcgaacggcgtcaccgagatggacccccgttgcggccgcagcacaggcgaagcgtaaaaagcgtgcaaaccgccggttcatgctcatgatcatctccatggtgatcatgctgctcgtgggtgtgggcctcatcgtgtaccccaccgtcgccgacgcgtggaaccgccatgtgtcgagtcgtgcgatcgccggctactccgagcaggtggcgaacacgccgaaggaagatcgcgaggcgcagatcaagaaggcgcgcgaatacaacgagaacctgctcgggcagggcaatgcgcgcttcctgccgaacggggaggagaagaaagtctacaattcgattctcgacgtctccggcaccggcatcatgggctacatcgcgattccggcgatccacgcgaagctgccgatctaccatggcaccgacgagacggtgctgcagatcgcagccggtcattacgagggctcgagcttcccgatcggcggtgaatccacgcatgcggtgatcaccgggcacaccggcctgccgtccgcgcagctgttcaccggcatcgacggcatgaagaagggcgacaagttctcgatcaccgtgtacgacgacgtgctcacctacgaagtggaggaacgccaggtggtgctgccgaccaacgtgaagccgctcgccattcaggagggtcgtgacttggtgagtctggtcacctgcacgccgtacggcgtgaactcgcaccgcctgatcctcaccgcgcaccgcattccgacccccgagaacaagaaagaggtcgaggtgaacccggagcgcgcgatcatgagcgatatcgcgatcaccgcgttcgtgatcgtgggcgtcgccgtgtgcatggcgacgatcgtgatcacgcagcggcggcgtaggaagacgcatgcgcatggctcgcacctgcgttcgagaaaatagcggggaaatagtcttgcgaaaatgagcagacgcacgcgtatggcctgtgttttccctatactgaacacgttgggcgtgcgcgtgtcgcaagcgcaagcgaatgaaaaaccgagcagggagttccatgaacaaggcaatcatcaccgtcgtcggccaagacaccgtgggcatcatcgcgcgcgtgtgcacgtacctgtccgaccaccacacgaacgtgcttgacatctcgcagacgatcatcgacggcttcttcaacatgatgatgatcgtcgactatgcagacgccgacgtctccttcgagacgatcgtcaacgacctcgaggagctcggcgaggagatcggcgtgcgcatccgctgccagcgcgaggagatcttcacgaagatgcaccgcgtgtgagcgccgcattcggtttctcgatttagactgcgaaaaggaacactatgctgaatattctggaagttcatgagacgaaccagatgatcgagcaggagaagctcgacgtgcgcacgatcacgatgggcatcgacctgatggactgcgtgtccaccgatctgcagaccacctgcgacctcatctacaacaagatcacctcgtatgcgaaggacctcgtgtccaccggcgagtcaatcgaacgcgacttcggcattccgattgtgaacaagcgcatcacggtcacgccgatcgcgctcgtcggcgccagctgctgcaagacctccgccgacttcgtgcagatcgcccacgcacttgaccgcgcggcgaaaacggtgggcgtcgatctgatcggcggctactcggcgctcgtctccaagtcgatgacgccggccgaggaactgctcatccgctcgctgccggccgcgctgagcgagaccgacatcgtctgctcgtcggtgaacgtgggttccacgaagaccggcatcgacatgaactcggtggagctgctcggccacatcatcaaggagatcgccgaagcgaccgccgacatcgattcgtacggctgcgtgaaattcgtcgcgttctgcaatgcgcccgacgacaatccgttcatggcgggcggtttccacggcgtgaccgagggcgacgcggtgatcaacgtgggtgtgtcgggaccgggcgtcgtctcgcgcgcgctcgatgcagccaagggcaaggatttcgaattcctgtgcgagacgatcaagcgcaccgcgttcaagatcacgcgcgtcggccagctcgtcgcccaggaggcatcgaagcgcctcggcatcccgttcggcatcatcgacctgtctctggcgccgactccggcggtcggcgactcggtgggcgaggtgctcgagaagatcggtctggcgcaggtgggcgctccgggcaccacggcggcgctcgcgatgctcaacgaccaggtgaagaagggcggcatcatggcgtcgtcgtacgttggcggactctccggcgcgttcattccggtttcggaagacaagaacatgatcgacgccgcggaaagcggttgcctgaccattgagaagctcgaggcgatgacctgcgtgtgctcggtcggtctcgacatgatcgcgattcccggcgacaccaccgcgtcgacgatctccggcatcatcgccgacgaggctgcgatcggcatggtgaaccagaagacgaccgccgtgcgcgtgattcctgtcgtgggcaagacggtgggccagatggccaacttcggcggattgatgggctatgcgccgatcatgccggtgaacacggcgagctgtgaggcgttcgtgacgcgcggcggccgcattccggcgccgatccacagtttcaagaactgagcggccgtttcagcttgcacatacgcgggcatggtattcgaataccgtgcccgcgttcatgtttgcggtgcatgtctcgttttgcaatcccagtctcagatcaggattggcgcgtgcggcgtgatcactggccgccgtcgaaaccgagctggcgccatgcttcgtagatggcaatggaagcgcagttcgtcaggttgaggctgcgtaggctcggacgcatcggcagccgcacctgttcggccacatgcgggccggccatgatgtccattgggtcgggaatattgccgggctccgggccgaacagcagaatgtcggtcggcttgtattcgacctccgtatacagcttcgtggcgtgcgcggtgaatgcgatgatgcgcgaattcggcatcgattccacgagatcctcgaaattcgggtgcaacaccacatgggccatgtcgtggtagtcgaggcctgcgcggcgcagcttggtgtcgcgcagattgaacccgagcggttccaccagatgcaggatcgtgccggtgaccgcgcacaggcggatcgccgagccggtgttgccggggatgcgcgggctgtaatagcacagatgcggcgtggtcgtcggcgtctcggcggcctcgcgggccgtcatcatcgcatcggtgacggaaatcgggttgccgtgcgcgtcggtgaccagttcatccggtccgtaattcgatttgcggtaaccgtattcgaacatcttctccacttgggcttcgggatcggcgtgctgtgcggggatttcctgcggattctgggaatgtgcggtcatggtcacagcgtattgcggtcaatcgacagttcggccatgcaggtcggggcaatctgcggtacgatgttgcgctatggtttccgacatggcagatgcctccccccgcacaaagtcccgcaaacgcgcgcaggccacgcccgagcagaccgtgggcgagcggcgtgcccgcgaactcgaacgcagcgcccggcaggcattgcgtgaactcgccacctggtggcagacctcggcacgtgacttgccctggcggtacggacgcacaacgccatggggcgtgctcgtctgcgaggtgatgagccagcagacgcagatgagccgcgtcgtgccgtattgggaggcatggatgagccaatggcccgacgccgcttcgcttgcggcagcagagaaatccgaggtgatccgcgcatggggacgtctcgggtacccgcgtcgcgcactgcgactgcaggagtgcgcggaagtggtggcacgcgactacgacgaccgcctgccgcgtgagtacgacgagctgatggccttgcccagcgtgggcgattacacggccagcgcggtgctcagcttcgcatacggcgagcgtgtcgccgtgatcgatacgaatattcgccgcgcgctgagccgcgcgttccttggcgtggaatccttgggcggctcgtgcacaccgctcgagcgcgcgctcgcatgggtagtgctgccgaaggcggcggagcagtccgtgctgtggaaccaggcggtgatggagctcggcgcgctcgtgtgcacggcgaaggcgccgcagtgcgaacagtgcccgctgcaaccgcaatgcgagttcgtgaaggccggcatgcccgggctcggagagaaacgcacacggccgcggcagcggttccacggcaccgacaggcaggtgcgcggcagcattctgcaggccttgcgcgcgttgccggcgggcggtgcgctcacgcatgcgcaggccgagggactgtgtgcggacgccgtgcagctcgaccgctgcatcgcatcattggacgacgacggcctcattgagattctgcccggccacgcgatgcgtctgccggcgtagtgtgtcagagccttacgggatgtcttcaatcgttacgggatgtcggtaattcttacgggatgtcacccttctcctgcgggatgccgctttcaccgctgcggcacatccggctaaaagacggaaaagccctgttttcgccgatgacacctccaaaatgtcgaagacattgctcacacaagtacataaatgacatcccgtaagaattaccgacatcccgtaagagatagatgtgatatggggctgcaggaatgaccagtaaggagtagtgcagctcgtgggggacagcaacggggagcgcgctcggtagactgggagcatgagctcaccacaatcgccacgccgtggcacgacgcgcaccaccggcggcagaaagcgcatgaccgcagcggaacgcaagcgcctgtaccgccggcgtcgcatcgtgttcttctcggcgcttgcggtggtgttggcgctcgccgtgttcaccgtatacagtctggtgcgcggtgcggtgagcgtgcatggcatggcgggggcctccgccgcgcctgcgctgagccgtgccgaggtgcctgccgcgccgcagaggagcaaggtggagacgtgcacgcccggtgatgtggatgtgcagctcgtgccggatgccacgtccgtcggcgtgggtggctcgctcgacttcaccgaacgggtcgcgtatgtgggcaaaagccccgaaggatgccgcatgaacacggccgccgacagtctggtgcttacgatcacctcgggttccgatgtgatctggcgttccgatgtgtgcgaggcggcataccgcccgcgcctgttcttcgccgacgtcaccgacgagcagaagatcgcgtggaacacgaaccgcacgggcacctcctgtgtggccgacgaccagttgccgaaggtcgatcgcggcacgtatgtggcccagctcagcctcaaggacgacccgaaggtgcagagcaaaccgcagacgatcaccgtggagtagacaccgccgaattcgggtatttcgtgcagatcggcacatgcgacacgccgggcactgtgcgagggaatataatttgcgttttcgagttgagtctgctaaattattgtctttgcgtatagattgtcatatagcgggcagtctgccagacgaagcgcccgtgtgcaggcatatggcggccccctcgcgcttccttaacaatacaccgaccaaagtgagcgattaaggaacgtccattgtcacagactacgacgaataccacctccgtcaccgcacgcgcagatcagcatgacatcgatctgcacaaggcttcggaccgtgtgaatttcggctccatcaaagaacccatcgacgtgccgtacctcctcggcgtgcagaccgacagcttcgactggctcgtcggcaacgagcgctggaagaagcgcgtggaggaagacgaggcgaacggcaccaacaccgtgccgcacgtctccggactcgatgaggtgttccacgagatctccccgatcgagaacttcgcacagaccatgagcctgacgttctccgacccatacttcgaggaaccgcgccacaccgtgcaggaatgcaaggagaaggactacacctactccgcgccgctgtacgtgaacgccgagttcgagaacggcgagaccggcgagatcaagtcccagaccgtgttcatgggtgacttcccgctgcagaccccgcacggcacgttcatcatcggcggcaccgagcgagtgatcgtctcccagctcgtgcgttccccgggcgtctacttcgaccgtcagccggaccgcacctccgacaaggagatcttcggcgccaagatcattccgagccgtggcgcatggctcgagttcgagatcgacaagcgcgacttcctcggagtgcgcgtggaccgcaagcgcaagcagtcggccatcgtcttcctcatggcgatcggcatgacccgcagcgagatccgcgacgcgttcaaggattacccgctcgtgctcgatgccctcgagaaggagaccatcgactctgaggacgccgccctcgtggacctgtaccgcaagattcgtccggccgatgccgcgacgccggaagccggccgcacactgctcgactccttctacttcaacacgaagcgctacgatctggcccgcgtcggccgctacaagatcaaccgcaagctcggtctggagaaggattacaacgaccgcagcctgagccgcgaagacatcatcgccacgatcaagtacctcgtgacgctgcatgccggcgacgccaccttcccgggcaagcgtgacggcgaggacgtcgagctgcgcgtggatgtcgacgacatcgaccacttcggcaaccgccgcatccgccaggtgggcgagctgatccagaaccagctgcgcaccggtctgagccgcatggagcgcgtggtgcgcgaacgcatgaccacgcaggacgccgaggccatcacgccgcagtcactcatcaacattcgtccggtgaatgcgacgatcaaggagttcttcggaacgtcccagctctcgcagttcatggatcagaacaacccgttggcgggcgtcacgaacaagcgccgtctctccgcgctgggccccggcggcctgtcgcgcgaccgcgcctccatggaggtgcgagacgtgcacccgtcgcacttcggccgcatgtgcccgatcgagtcccctgaaggcccgaacatcggcctcatcggctcgctggcgaccttcggccgcatcaaccccttcggcttcatcgagaccccgtaccgcaaggtcgagaacggccatgtgaccgacgaggtcgtctacatgaccgctgaccgcgaggtcgagcacgtgatcgcccaggccaaccagaagctcgacgagaacggcaacttcgtcgagaaggaagccttggtgcgtgacgccgccggcgaggcggaggacgttccggtcgagatggtcgattacatggacgtctccccgcgccagatggtgtcggtcggcgcatcgctgattccgttcctcgagcacgatgaaggccaccgagcgctcatgggtacgaacatgcagcgtcaggccgtcccgctcatcaagtccgagcgcccgctcgtgggcaccggcgccgaatggcgtgccgccgtcgattccggcgacgtcattctggccgagaagccgggcgtggtcatttacgtctccgccgacatcattcgtgtgatgaacgacgatggcacgacctcgagctacaagctggccaagttccagcgctccaaccagaccacctgctataaccaggtgccgctcatccacgacggcgaacgcgtggagaagggcaccgtgctggccgatggcccggccaccgagaagggcgagatggcgcttggcaagaacctgctggtcgccttcatgccttggaacggttacaactacgaggatgccgtgatcatctcgcagcgtctggtacaggacgacacgctctcctcgatccacatcgaggagtacgagatcgacgcccgtgagaccaagctgggcgccgaggagatcacgcgcgacctgccgaacgtgggcgaggacgccgtggccaacctcgacgagcgtggcatcattcgcattggtgcagaggtcgaggccggcgacatcctcgtgggcaaggtcaccccgaagggcgagaccgagctcacgcctgaggagcgtctgcttcgcgccatcttcggcgagaagagccgcgaggtgcgcgacacctcgctgcgcgtgccccacggcgagaccggcaccgtgattgccgtcaaggagatcacgcgcgaggatgccgaggaggacggcgacgagctgccgaacggcgtgaaccagatgatccgcgtctacatcgcgcagcaccgcaagatcacccagggcgacaagctctcgggccgtcacggcaacaagggcgtcatctcccgcattctgccggaagaggacatgccgttcctggcggacggcaccccggttgacatcatgctcaacccgctcggcgtgccttcgcgaatgaacctcggccaggtgctcgaactgcacttggggtgggtcgcccatgccggctgggacatctccctcgatccggatatggaagccgaatggaagaagatggtgccgaagggcgccgagaagggcgagccgggcaccccggtggcaaccccggtgttcgacggcgtgcgtcaggacgtgctcaagggcctgctttccacgacgctgaccgaccgcgacggcaacaagctcgtcggcgacaacggcaaggcgacgctgttcgacggccgtaccggcgaaccgtatccgaagccgatctccgtgggctacatgtacatgctgaagctccaccatctggtcgacgacaagatccacgcgcgttccaccggcccgtactcgatgattacgcagcagccgttgggcggcaaggcccagttcggcggccagcgcttcggcgagatggaggtgtgggccctcgaggcctacggtgccgcctatacgctgcacgagatgatgaccacgaagtccgatgacgtcgatggccgtgtgcgtgtgtacggtgcgatcgtgaagggcgacaacctgccgcctgcaggcatccccgagtcgttcaaggtgctgctcaaggaaatgcagtcgctgtccctcaacgtcgaagtgctcaacgccgaaggcgtggccatcgacatgaaggacgaggacgacgatcctgtttcctcctccaacgatctcggcttcaacatcggcgcccgcccggacgccgccgcgaaggccgaccaggtcgctgacgaaccggaataccgctgaacgggcactcccgcacagctgtgctaggaacaagacgattttcaacagacaggatattacgtgctggacgtcaacgcatttgacaaactgaagattggcctggccaccgccgacgacattcgcggttggagctatggcgaagtcaagaagccggagaccatcaactaccgtacgctcaagcccgagaaggacggcctgttcggtgagcagatcttcggaccgacccgcgactgggagtgcgcctgcggcaagtacaagcgcgtgcgcttcaagggcatcgtgtgcgaacgctgcggtgtcgaggtcacccgtagccgcgtgcgccgtgagcgcatgggccacatcgagctcgccgccccggtgacgcacatctggttcttcaagggtgtgccgagccgcttgggctatctgctcggcattgcgccgaaggaactcgagaaggtcatctacttcgcctcctacatggtcacctcggtggatgaggagcagcgtcatcaggatctgcctgatctgcaagacgagttcgaccacgaggtgcagaatctcgaacgtcgccgcaacaacgagatcgaggagcgcgccaagaagctcgaagccgacctggccgaactcgaagcggacggcgaggtgaagggcagcgccaagacgaagctgcgcaacggcgcggaacgcgacatggcggccatccgccagcgttacgacgaccagatcaagcgcatcgccgcggtgttcgacaagttcaagtccctcaagccgggcgacatggagtccgatgtggacctgtggcgtgagatggaggatcgctacggcgattacttcgaaggctgcatgggcgccgaggcgatcaagaagcgcctgcaggacttcgacctcgaagccgccgccaaggagctgcgcgaggagatcgagactggcaccggccagcgcaaggcccgtgccctcaagcgcctcaaggtcgtcaacgccttcctgaccaccgacaacaagccggaggccatggtgctcgacgtgatcccggtgatcccgccggatctgcgcccgatggtgcagctcgacggtggccgtttcgccacgtccgacctgaacgacctctaccgtcgtgtgatcaaccgcaataaccgcctgaagcgcctcatcgaactcggcgccccggagatcatgctcaacaacgagaagcgcatgctccaggaagccgtcgattcgctgtttgacaacggccgtcgcggccgcccggtcaccggtgcctcgaaccgcccactcaagtccctgagcgacatgctcaagggcaagcagggccgcttccgccagaacctgctcggcaagcgcgtcgactactccggccgttccgtgatcgtggtcggcccgtcgctgcgcatgcaccagtgcggcctgccgaagccgatggcactcgagctgttcaagccgttcgtgatcaagcgcctcgtcgacctgaactatgcgcagaacatgaagagcgccaagcgtctcgtcgaccgcggtgattccgaggtgtggggcgtgctcgaagaggtcatctccgagcatccggtgctcctcaaccgtgcacctacgctgcaccgactgggcattcaggccttcgagccgatcttggtcgaaggcaaggcgatccaccttccgccgttggcctgcgccgcattcaacgccgacttcgacggcgaccagatggcagtccatctgccgctgtccgccgaagcccaggccgaagcccgttcgctcatgatggcttccgataacattctgaagcccgccgacggccacaccgtgaccatgccttcgcaggacatgatcctcggcctgtactacctgtcgaccgtcatcgacggcgccaagggccagggccgcatcttctcgtcgctcgaagaggcgcagatggccctcgacaagcatgagatcgacatgcaggccaaggtgctcatccgcctgccgcaggacttcgtgctgccgaaggattgggagccgggcgaggtccaggtcatcgacccggagccgggcagcccggacgtggtgaaggaggagcgtttcgcagacggttccgtgctgttcgccacctccctcggccgcatcctgttcaacgacacgctgccggtggactacccgttcatcaacgagcaggcgccgaagggcaagctctcgaagatcgtcgacgacatcgcgacccgttactccacccagcaggtggctgctaccctcgacgcattgaaggatctcggcttcacccgcgcaccgtggtcgggcgtcacgatggcgttctccgacatcgtggccccgccggaccgcgaggagatcatcaagggctatgaggcacaggccgccaaggtgaacaaccagtatgatctgggcctgctcaccgaggaggagcgccgtcaggagctcatcaacctgtggaccgagtgcaccgacaaggtcgccgaagccatgcgcgagaacttccatgacgacaacaacgtgaacatcatggtgcagtccggtgcacgaggcaactggatgcagattcgccagatcgccggcatgcgtggtctcgtggcgaacccgaagggcgagatcatcccgcgtcctgtgaagtcgaactaccgcgagggcctgtcggtgctcgagtacttcatctcgcagcacggcgcccgcaagggtctggccgatacggcactgcgtaccgccgagtcgggctacctcacccgtcgtctcgtggacgtctcccaggagatcatcgtgcgcgaagaggactgcggcaccacgcacggtctgcccatgaccgttgccgagcgtgacgagaacggcaatctcgtgctcgtcaaggcggcggacggcggcccgtactcgcgtctgctcgctcaggacgtgctcgacccagccgacggcaagaccgttctgtaccacgcgggcgacgccctctcgatggacgtgctcaacgacctcgtggcacatggtgtggagcaggtgatcggccgctccgtgctcacctgcgaatccaagcgcggcgtgtgcgcgaagtgctatggctggtcgctggccaccaacaagctcgtcgacgtcggcgaggcggtcggcatcgtcgcggcacagtccatcggcgagcctggcacgcagctgacgcttcgttccttccactccggtggcgtcgcctcggcatccgatatcacgcagggtcttcctcgtgtcaccgagttgttcgaagcccgtacgcctaagggtgaggcgccgatctcggagtttgccggcaccatcaaggtgcaggacaccgagcgtggccgtgaggtcattctgcagccggacgacgactcgctcgagcccatcacctatcaggtgacccgtcgcgcgccgatgctcgtcaaggacggccagcacgtcgatccgggcacccagctggtcgagggttccgtggatccgaagaagattctgcgcattctcggaccgcgtgccgcccagatgaacatcgtgaacgaggtgcacgacgtgtaccgttcgcagggcgtcgacattcacgacaagcacatcgaggtcatcgtgcaccagatgctgcgtcgcgtcaccgtgatcgattccggtgacaccgacctgctgccgggtgagctcgttgaccgcgcacgcttccgcgagcagaacaagaagaccgtcgccgccggtggccgcccagcagcgggccgcccggagctcatgggcatcaccaaggcttcgctggcgaccgactcctggctgtccgccgcatcgttccaggaaacgactcgagtgctcaccgaggccgccctgaacgagaaggaagacgacctgaagggcctcaaggagaacgtgatcatcggcaagctcatcccggccggcaccggtctggcgcgctaccgcaacgcgaccgtggagcccgacaaggcgatccgcgacaccatctacccgaacttcggcctgggcgacggttcgctcggtggtgacctcagcgatggtgatctgggtgacgtcgacttctcgaacatcgatttcggtgatctgaagctcggcgacgacttcaacccggacgacttcctcgacgacaacgacaacccggtcgacttcggagacgagttccgcatcgacccggacgaactcaagtagtccgagccgacgtctgacctgaaaggtccccacacccatggcgggtgtggggacctttcactgtatgcgggcgcggaatctgcccaaaaaatggggatcgaagccgggaatgtgccgcggtgtggtacaacatgggtatgagcagaattccgtatccaccggcaccggagccgggttggtatgacgatgacgtcgacgcggtgccgggggtcgcgttccccgcgtacggaacgcaggagatgcgccgtgtgcaggcgcatagacaagatggacaagtgagtgagcagcccgaatggcatggcgagccagatgactacgccggggaacccgatgagtacacggcggaaccgggttcggaaggcgatgcccagtgggacggcaccgtgctctccaaacgattcgcacgcgaaaccgaacgcgaagcggtgttgacgaatgcggtgacgaaccagcatatcgacatcaatatgaacacgttactcgggcgcaagccgtcgcacgacattccggaaggttcgaaatcggtgcggctcatagaccccacgcgtacggtctcccgcaatcactgcgcgatcagctacggcgagcatggcacgctctggttggaagacatgggctccctcaacggcacgtacgtcgtgcatgacgacgaggagatgcgcgtgagccaaggtatgccggtggagctcgatctgcctgcgaacattcgcataggcgaccagttcttcacactcgatgcccgctgaactggcgttgccctctaacgtgcacggcgtgcggcgattgcctcgttgacctccgtctcattgagcgaagccagccagttgagcaattctgggtagatatacggattttgcaccagatacacatgcagatccggtgcgtactgggcgatgtcgtgcatcaccgccggatcagacgtggtcatggccagctgcggcgtgaattcgccattcgcactgtactgcgcattcggattgctcgccgttgcccgatcaggctgcgtcgccagcgtgtgctgtgccgcctgcgtagattgcgctggctgggtgaatcgcgtggggcgcgcctgcactggttgctgcgcgcccgaattgcgcaccagttgttccacggcgagtttcacggcgcgcgccggttcggggttccgctgtccagacggggtctccgactcgtcgaagcggtcttctacagggtctgcggtggcgatgacgcccatctgcgcgagtgtcatgcgcgcccgtttgtcgccgaattcggcgagccagcgcttcagtccggggtaggcgcgtggatgcaccgccacgttggcgccgaactccgggttctcgtaggcgattttggcgagcaggatcgggtctgcctgagggtcttgcactgcggccaccgccgtctgatagtccaccatcgagattcctttcctgctcgcagatgttcggcatgcgcagcccacgcacagtctccgcatgtggagtcttcctcaactcgcacgccgccatactagcatcaatcgccgtgtgtggccggaccgccgcatatagtggactcatctgcataaataaaagcatcccaccttgcgtaagagggcagcttgttctgcttgacctgtttgttcggtttgatctgcttgccctgcgtaaaaagggacagatttgcgaacgaagatgtccctttttacgcagggtggtcggatgtctctttgtatgcatggtgccggaataggccgcgcagactcagtcgcgtgcgcacgcggcgccagaacggcagggtcttcagcaatgcggcgcgcatgccatccacagactcccaatactgtacgacctcgctttcaggcacaggattgcccgagaacgcggcataatccgccgtctgcgcgctgtgcctgagctgcgcttcggtgaccggcccacggctcgtgtcggaggggctggcggtcgcttcggcagcagattccgcggcgaaggacctcgcgatggcatgcgcctgctcacggcgtgtgccgtgcacgggaatgccgctttgcatcgcgaattgcgtgagtgaacgccagccggactccacacggtgattcgtgctgccattcctgcgcaatcgcatgagcagcgccgccttgaccgcaagaatgcagccgcagatgacaaggagaatccacacgggggagccgtatatagcgacgtcgcgcgtcaccgcgccgattttcgaccagactcccgaggttcgcgggtcttgggcgtcgtctccggagagcacggtgcttcctgtggcctcctgcttgtcgcgcagtggatcggtgaggggcagtggcggttggcgcacgagtgtctgcggattcgggggagtgggattctgattgtcttcaggggtcttcgtctcctgaggcgtagggtggaacgccacccaaccgtgcccttcaagcgcgacctcaacccaggcttcgatgtcattgccggtgaagtcggttgtggtgccgttctcggttctctgtgtgcgggcctcggtgatgtcgccatgctcgtccttgggcacgaacccaagcaccacgcgcgacgggattcccaaggacctcgccatgagggccatcgccgacgcatactgttcgctgtctcccaccattgcggtgccgccgagcagctgggtgatccggtagttgccatgcccggcaagcgaagggtagtcgtccaccaaaccgtgcgagaaccacccgttgtcgcgcaggccgttcgccaatgcgagcgcagccgcgccagccgtgggctgacctcctgcaaaggcctccgccatgcgccgcacggcattgggaatgtcgccggcatcggggagcgcgatgcgtgcggcctgtgtctgccgaatctcatcatcactgggacggcgtgcaagcgtgccggtttcggtgtaggcaagtccggaacgtacgccggaagtgagcagaccggattcggtgcccgtgttgtagtagaaatcgtcggcattcgcattggtggcgaaggtgacctgcgtcgccgcgccggcaagcggcagccaatcgtcacgcatgccgtcgcgcacgtcgaacatggcagtgaaccaggttccggagtcatcgccgtcctgtgtgattcgcagacccatgcgcgtgtagttcgaggatgcgccggcaatccgcgtgttcgatagattccacacattgccgtcgaaccgatccatcacggcgagacgcacgctggcccccgccggcagattgcgcacggtgagcagtgtgtctgccttatgctccttcagatacgcgcgcatgcccgacatcgggctcgcatagtcgaagggcgcaagcggcggctcgtaatggtcgcgcagaatcgttcgcgtggcgtggacgggcaggcatgcgcctacggccacggcgcccgccagcagcaacagtgcgcccgcaccgagccatcgtgacatttcgaacagtcgccagcgccacgacagccagactacggcggcgagcgcgcaaaccacgccgcatggcagccgaagcacgcctgccgatgtgccaagcagcgcgcagacagcgaaatcgccgatcacaaccaatacgctcaatgcgctccatcgccgttgggggagcacggccagcacgccgccaagtgtgcacgagagcaggcagagcgtccatacggccatgagcgagccatccgcggtgccggtcggcgccggcacggcgatgaggaacttgaacgacgtgaacatggcggagcaaccttcggcgagggtctgccacgtcggcagcacgtaggccacgcttgtgtgcggcagtgcgaccagcgggccgatcacgcattgcgcgagcacggacgccagaatctgccaccagaacctcaaccggggcaccagcgtcatgaacgcgatgccagaaccgagcaatgcagccggaatcgcggcgcgcgcccagctgccggccgagccgtacacgtcaatgagattcgcgcatgcgcacagtacgattgccatcaccacgacaagtgagatggcggcatcgcgtgtggcatggccagcggcatgtgcggcatcggcccgacgcgcgtcgcgggcgttcatcgtcagccagacgggcatttgcgtggaattgtcgttgatccacgaagcatcgccgcgggtgcggccgtgtcttgtcgcgccaaaggaggaggtcggcgaagtcatgagagcacctccatgagtagcggaaggtcgtcgagcacgccgaccgtgatgaacacgcattccggcagcgtgcgcaccgcgctgctcgccccggcgacgacctgcacgaccacgcaggtcgccgaatccggaatggcggcgccaagcctgcgcagatcgtccacctcatgcgcggaaccggcgacaaagcagtacagcgatgccttgtcgcaggcaagcagggcctcgcgtgccagattcgccagcatggtgcccccacgcgtttcaggttcgatctcactgcacgtgtcgagaaagtcggcgggtttgcgcggctgcacatgcaatctgccggattgcgcatacagcgcacgccgttctgacacacactgcacgccaatcgaggcgaacacgctcaccgcgagttcgaactcctcggcgctcgcatacgaaaacgccgcaacgtcaagactcaccgacgaatcggtgcgacgcgtggcttcgaattgccggatcatgagcgttcccgttttcgcggtgctcagccagtgcacattgcgcacgtcgtcaccatattcgtattcgcgcagaccgaagaaactcaggtcgtcattgacgaggtcgtcgctcggattgccctccagatcacgtatgattccggcgtgcagtgtgtgcagcggcacgatgtccgggtgaatgtacacgcggatctgctcggtgagacgatgctcgcgccgcaccaggccgaacgggtctcctttgcgcaccgacaatggcccgactgtgaccaccgcgcgatgcgttgcggtgaggggaatcgccgtctgcttcgactggtgggcgccgagactcggtatggcgaagcgttcatggtgccactcgagactgccgtagttgctctgggatatcggcagatcgccgctcgcgctcgcggtgacggaggtgctcggattcgacacggtgaccatggcgtgcatcgtctggttgacgctcacccgcgtgttcgataccgaaagcgtggccgtgaacgcagtgttgcccactgaaagcgccgcggagcttacgagcaacgtggcgcacacgagtgcgaacgcaagcatctccacccaacccaggcataggaacaacgcgagcgtgagcacgaacatgccggccaccgcccagcccaatggcgatacgtatttccgtatggccatgtcagcgctcgccatgcgtggattcgtgggcttcgttgagtcccgtctgcggcaccggcacgtcgtcgatgatcgcctgcattgcactgtgctggctctggccggcgaaggtggcatccggcgtgagcgtcaggcggtgggcgagcaccgagatggcgagatccttgacatcgtcaggaatgacgtaggcgcgattgtcggccgccgcccacacacgggcgcaacgggtgagcgcaagcgcaccgcgcatggaagatccgacggcgacgagctcgctgttgcgcgtctgctccaccagccgcagaatatactcgtagatcgcgtcgtcgatatgcacctgttgcacggccttgcgcatgtcgagtatgtcatgggcgctcacaacgctgccgatggtgctggcgcgatcggtgatgtcggcctccttgagcaactgcatgctccgggtcctggatgggtagccgatcgtggtgcgcagcaggaagcggtccatctgcgcttcgggcagtgagtaggtgccgagctgttcgatcgggttctgggtggcgatcaccatgaatggctgcggcaccgtatgtgtggtcccgtcgacggtgacgtgctgctcctccatcacctcgaggagggccgactgtgttttcggtgaggctcggttgatctcgtcagcgagcacgatggacgcgaacaccggacctgggcggaacgtgaactcgccgttcttctggtcgtagaaggtgactcccaccacgtcggagggcagcagatccggggtgaattggatgcgtttgaacgaggtgtcgatggattgggcgagcgctcgggcaagctgggtcttgccggtgcccgggttgtcttcaagcagcacatggccgccggcaaggagggcggtgacgcactcgcgaatcgttttctccttgtccaccaccacttgcgatatgttcgccacgatggcgtcgaacagactgtggaaccgcacaatgtcgcccttgtgagcagattcgctccgaactgcggtggcatctcgctcggtcggcatattcacggtgctcacggtctcggtgaccgtctggacttcggttcgcgacggtgaagcatggacgcctcccagccgggtggcgtcggaatccggcgccacgtccgcaggcgtgtggaagccccgtcgtgagaggacggtggattcgtagccctcgtccgtatgctgtgcatggggtgcatcaggctgttcatgcttggctgtcatggaacctctcctttgcaatatgatgcggctcgagactgtgatgccctgccggaagtcgtggtgtcgtgtgccaggcgattgtgcgggttgtggccgcccggcgaatgccctgtaccgtgtgctcttcggtgcgtgcggcatagccggcatcctcgttcatggtgatgcttgcggtccagcgcagattgtctgggactgtgctctcgccgggtgccggacgaaccgtgacatcggtgtccggattccagcgcgtggtgaatccgttgctgaacgacaaggtgatggtgacgggctggccgtagtcggtgaaggcgcgccctgtgttgcgcatcacgatggcatcgcggttgtgctgcgaccagctcacctcgatttcgttggcgtcgacggttggcgccacacggtactggtgtgtgctcgttgcccgtgccggtgggctgtaatggccttggagccgggtgcgtacctcgcccgcagggcagcgctcccacggactgagccgcactgtctcactgccggcgggctccctgtttgcatcgatggaaccgaatttcacatgaacgccgtcatgcctgccgcgtggcaccgaccattccaatatgcactcgtcattcctgccctccatgcgcacacttggctcggcaatgccgatggtgggctcgatggtgttcgattgtcccgtcgccacagttgcgggacgccttgatgtgtgcacggtggcgctcacgctcaacggcttgaaatacatggcattgtcgaggggaaccctgaaccgcagcgattcgcacgatgtcgtgccatgggagagctggatggaggcgcaccccgccctgcgcatgttgccgagcgtcacggtgccggtgatctcatggtcgttggcctgcgtgatgctcacttgcggggcatcggggtctccccacacgtcccgggttgacacgagtcggctcggcacactggctccgacttcgttgttcgccacgacggtggcggagaaggcgctcgagtcggtgatcacgttgttgtcgatctcgaaggatgtggcgagcgccgtcaccctggtgttcgtcttcgtccaaccgtcgggcccctgcaattgcacggtgtaggaacttgggcgcgagcctgcgtagtccggctcgttccacgagacctcgacgctgcggtgaccgcccctcacctgcacctgtccggggggttccggtgcccgattgggtctacccgtcaccgcattggagtccggcgaccagcctatggcgttgcgtgcccgcaccgtgaacgtataggtggtgccattgtgcagattcccgatgcggcatgatgtcacgtttccgcaggattgttcgcctccctgccatctcaccagatagtcggtgatgggcgagccgttggcgctgccggtcgtccaattgagtgttaccgctgaatcctcgggttttgcggccacgggggaaagcaacggggcgccgggaacattctgcacgacgactgtgagcgtggcgcttacgctgcgttcctcggttttggtggcatccatgacggtgatcaccacatggtaggtggcggctggcattgttggaggcgccgagagacgcagaacggttccctcggtttgcatttgcagcgtggagtctgcatccgcgttcgccgaaacaaggctcagcggggtttgggggaatgggttgtacgctccttgagtcacatcgatgccggtgctttcaccgggtttgagcctgatggtggcggggttgagccgggccaatgggcgtgtggacggcacggcccgaacggtgataccggcgtggagcgcaccattgccatagtcgagcgtgatgggaatcgattgggtggcacccggtgtggcggtggcgtcggccgccacggtgagtttgccgtcggtggtgagtgatgtggtgaagggtgcagacgattgacctccagtgaacgagtatggtttccgatcctcattcgccccgcctgagaccagtgcgttgaggtcgatcaccgtggcggcctcacctgcgacgacatccacggtggtgcctgcgaacgtcggcgcgggacgcgtgttgccgattacggtgatgggcaatgtgatcactgccgtgttgacgaatctcacattcgtgccccggctgccgtcagtcacggtgaaggtgatcgatgccggtccggagtagtcccttctcgcggtgaatctgagcgttccgctgttcaccacataatcgtcgttgtcgcttttcgtggcactcaccgactccgagttcgccagcatcggcgccttgccggcccctacgcgtacgtggtcggcaagcgggatggtgatggtctccccggcattgacccgcagagggggtgcctgaggtcgtagggttggcgggaacacgccgtaggcgggaacatggatgaatgccgtcgaggtgatgccgtgcgtcgtgttcgttaccgtataggcaatggccctcgcctcatcggtgagatcgatggagagcgtggtgtcgccggtggcacgcgcatgctgggcggcggacttgtccacattcactgcgagctcgtcgaggcttcctgacgggttggagatccatgccgagacatccacgttcaccgtccttttgtccacggtggcgcttgccggcacccggtaatcgtaggcgctcggcggttggatgggtgcgttcggatcgacggtgacgctcagcaacccgacatccttgacccccgctgcgttgcggaccgtgtagatgatgtaggcggtgccggtatggtcgggtgcggtgagcgagatcatgccgccctgcaccttcacgttgtcgatgccttggcattgcacgttgttctcgagcacaagattgctgttgtcagacgcgatgtcgttgcgcagcacgggcacggtggtcgaggttcccgggcgcagtgtcaccgagtcatcgcgggcgtagactcccgaatccgcgccgctttggaacacgccgacgcgaacctgcgcttgggcgcgcctgcccgtccagtcctccaccgcgtagctgaaggtgtcggtgcccacggaatcggcgaatgcctcgtacaccagataatccgctccggtttccatcacgcggccgagtttgggcgcattgttgcccaagccgagcaactgcacgtcatcgccgtccgtgtcgatgccggtcacgcgaatcgggatgcggatctttcggccagcagccacttgcgcctcgacatcggtgggtttcggcgcggatttcgattccgcgtcactgtcatgcacggcgaaggtgacgacggccgatgacgcgttgccgagggcatcggtcaccgtgtaggtgagcgggtaattacccgacgtactgggagcttggtaccgtacggtgttcgacgaggcgaaggcgagcccgcggaacttgcccgcatcagtcttgaggtttcggtccagcgcgagggccgaggcaccggtgtacgagacatggtcgagcacatccaccgacactatgcccccggtgcgtacgggtacggtgatgtcggaggccttcggcacggaatcggcactggtgagcgccggcggttgcaccacgatggtgccggtggcgatgccctgtgcgttcgccactgtgtagtcgagactcactggtgcagatggcagcgtctgagccgtgatatacacgcgtttatttcccacgatgcccgctttgatgccggatttggcgtcggccctgacatcggtgacggccagcacgccgcccatggggtcgacgtcattggcaagcggttccacgatggccgtcttgtcggctccgagcaatgccacgtcgttggcggcgaccggccttgccgattcctcctggtcgggttcgacgtctatgcgtgccagtcccgaggcttccacatcgccttggacaatcgtgtagggcacatgataggtgcccggttcgctcgactggaaggtgaacgacatgtcggtggcgcgcatggtgacgttcgtgcgttcgggattgtctacccgtgtcaattgcggggtatcggccgaggtggcgtgcacgaccttggacagatcgacggtcactgctgtgttcggcgtggtggtgcggcagaccggatctatgttcgccgccaaggtgtgcggcggacggatggtgaagtacacggttgcctcggtgaggttcctgccgtcggagacctgcagccgcaccgctgcacggccttcgcgcatcgaaccggcgtggaacacgagttcgccgtccgggcgtgcggagaccgtcgcctcgtcggtgttctccacactggcgccgaccagggtgagcggatcgccgtctgggtcgacgaagccgccaagcgcgttcatggtgtacgtggcaccctgttcgacctcggtttcctccggctgctccttgcgggttggtgtgcggttctggtcgccggcaatcgtcagcgtcacggtcgcccttgaggattgtccgcgcccatcgccgatctcataggtgaaggtcgcgcggccggggttgtgcgcgctgacctgcaggaaccggccatcatatatggcggacgccttcaccgaatcattctccggcgagctcactgaggtgatgcgtagcaccgagcagtcggtctgctcgtcgttgcgcaacgggtcgatgacggtgttggagccggcgcgtatgccgaactcgtcgtccactgcgcgaatctgccctgatttcgtggagcattcccgtgcgaacgtgtgcttcgaactcgtgctatcggtggtggtgctcgtctgacggctggtgtcgttgtcgagccgcttccactgaatctggatcacatccggcgaatccgccgggttccatatgttgccgttcgcgatgtcgttgagcacgacgagcctgtggttcacacgaaggcgaagattggccgtcgcggtgatcgcctgcagatcgagcatatcgggttcgccgttcgccgagcagacggtggcatagtttcgcgcggtttgactccatgccccgtgcacgcatccgttcaccgacacgggttgtgcggcctcgccggtgcctgcggtgcggtggatggcgggtttggctccctcgttgagcggcatcgtgaccagtgcgcccggtgcggccgccgcgacccaaccgcgttgtgagcggtcgtcggtgtcggctggaggtgcctgcaacgtcaaggttcccacgccatccacggtgatatggctccgaccgaagtacaggcggttgccgctgctggccactggttggccgtcgaccacggtgaaggaatccgcggcaatgggttcgccttcgttcagtgtgacgatttcatgcgccgtgttcgaaccagccccgacggtgtacacctttgccgtgtgggcgtcgaggccgtagacggtgccgtccgcggcgatggcgattcggccgccggtgccgagtttcatcgtcgcggtggctgtggtgggggagaggtgcgcgatgccatcggcttttcccacccatacctcgccgcggtcggcgtcgatgatcgcggcggtacggccacccaccagcgtgcgcatcgtggaggtggtcgcggtggcgtcggcggtacccatggtggattggtcgatgcccgaggctttttgcggctcagccaggatgacgtctccaccgtgctgcgcgatgtcgaagttcggcgactgtgcggtgacgctcgcatccggctcacgcagccgcacgttgtagcgggccgccttctggtcggcctgcgaggtcacccagacggtcccgtcgtcgagttgcagatgccgttgcgagaccgagtgcatgacgagggctcccgcgatgacggcgagcacgatgacgagcatggccgcgggcaccatccacgttttgccgcgaccgcggaatatgcgccgtggcgagaacttgtgcatgctgttgcgtggcgattcggtcatgtcacctcatttccgtaccgcgcaggcgatggcgggttgtgccgacatgctgcggtctgcccgcacaatgctcacgcgcacgcacacctgcgcctgatcggtttggtcagccggaatgtcaaagccggtggaatcgaccacatgcgaggcgcccggcgtggtcgcggcgccgatacgcgaccacacgtaggtgtcgccttcccgtggatctggattcctccaatggaaatgcgcgatgccattctcgtcgagggtgccggaaagctgttgcggcgacggcacaacggatgcgccggggggctcgttgcccgtgggttcgggccgttcgccgttctggagtgcgccgtggctgccttcgacaaccgtctggtttccgctggcatgggtgtcgagcccgggcagcacgaaccccatgaacaccgcgaggaacagggtgagcagcgcgacggtgaagcccgcgaccatccacgccttgcggtgtttgccgcgttgccgtgccgccggcggacgttcggtgatctgccggcgtgcgatgctggacggataggggtctgcgccctcgacattcaccggtgtggcgtgcccatacaggtcgaattgcgcctgctggagcgcgcgggcgaaagccagtgcggaggggtagcgatcgtcggcattcggcgccattgcgtgtgccaacgtctcatgcaccacagtgggaacgtcgttgcgctggatcgtcggcagcggttgcgtcatgatgagccttgccagctccttcgccgtcttcgggtggtacccgtattcgaacggggaggtgcccaccagtgaggcatagagcactgcgcccagcgaatagatgtcggccgcctcacctcccgcaccgcccgtgcgcagcgtctccggaggagcccacggcagggagtagccggtgctgctgtgatcgtaggcggtgacggcgatgccgaagtcggcgagcgtgggcaaccgttgccaggtgatgagcacattgctcgtcttgatgtcgcggtgcacaatgccggcccggtgagcggtggcgactgcgctggcgagatggactcccatggagagcatctgcggcacgtcgagcacatggttgcacagcacgtccttgagcgtgccgcccggtgcatactcgaacacgaggtaatagcggccgtcgtcggtgacgcccgcatcgtaggtggagagaatgtaggggtggctcgacaacgcggccatggcacgcgcctccgcgcggaaggcgtctgcgattctgctgtccacctgctcgacgctcactttgatggcgacgtcgcgttctatgccctgttgccggtagaggtagacggtagcggtggaaccgtgcccgagcacgcgcacatagctgtagccggcaaggcgcggtggctggggcacctgctgggtcatggcggctccttcgctggctgtgtaccggtgtcggggattctcccatatgtagattatcgaaatttgcgctcgactgcttgcgcgtaagccggcaatgagactgtcccaacgaagtgcggcgtttcgttggtcgttttgcgccaatatgggcagattgaccatgttggcgcatcgcatgctgcaacatattgcacgccatatgagccgcgatacgatgcaaatgggaatccggacggaccgctcggtacacggcgtttctttgacgtgcgcgcaggccgtccatacacttggagaatcggtgtggaggatgccgatgagggcgaggaggcaatgcatggtcgaacatacccaagagcatggagtcgctggcatggtcgccgatgacgatgcgccgcggaccaacgagggggctcgccgtgccattcgtgaattcctggagtcggttcacaatgatgaccggaactccaaggcgcgcaccctgctcgtctcgggtgccccgcgttcgggcaagacgcagctggccgtggagacgacgctcgccgggctgcgagccggcttggcggccggggacgatgggtcgacggtgatgctcgtgccgaaccgtcgcgtcgcggatctgtattccgatcggatcatacgcgaactcggctcaagcgaacgtgtgcgcccggccaccacgctcaatgcgttggccttccaattgcttgagatcgcccgttcgagaagcggcgacagcgcaccccgtctcatcaacggtgccgagcaggacgcattgttgcgccatgtgatcgccgtgcacgtcgaacagcatcgccgtggcgaggatggctcatgcgagacctgccggctgctcagcgcctatttcgaggatgcaggcgtgcaggcgccccccgcacggaagggggtgggtgctgctgccaactcctcgtccgcaggcacgctcgactgggcgaccattgtgatggatgccgccgatgccaacgatgccgacgaggagacgattgccgatatcgcagcgaacgtcaatgcaggattcatcgcccagttgcgcgacgtgttcgcccacttcgacgaggtgggggcattgttgcgtctcggcgcgatgcagccgacggcggctgcgcgcaatgtggaggaatggacgatgcaggtcgcctgccaagctgtggaatcggagggccccgctggcgtgcgcctctcgttgcagtggcgtctggcactcgcattgaggcgcgagtatttcgatctggtggcccggcgctaccctggtgaataccgtttggacccctcgtatctgccgcttgcggccatgcgctccctgactgttgcaggggcttggatgcccacgttgctggtggtggacgacgtgcaggatctcacgttgggtggcctggcgttgctcgcggtgctgcaggggctcggcgtgcatttggtgctgttcggcgatccggacgaagccgtgcaagcattccgcggctcatacccggaatacctctatgcacgcttcctcgacccgaacggcccgttcgccgccgaccatgtttcattgcaggcatttcagcacgagcccgccacctatcgggacatcgtggcgtcacgcgtgagcctgtcgatagcctccgccgaggaatcctcgctgccgttggcccagcggcccggaaaactgcctgccgtggaggggtcggaccgcctgcgcccgctcgatgccaacgacccgcataccaagaaggtgctggaagacggttctctcaacggcagactgtaccggtcggcaaacgacgaactcgacaacatcgtgtggcagatttcggcgctgcatctgaacgacaggaacgtgacatggaacgacatggccgtgatctgccatgacaacgccgacgtgctgcggttcggggaaaggctgcgcggggccgatgtgccggtgcggtattcgtcggtgacccggcctctcgcagacgagccgttcgtgcaggggctgttcgcgctcatcgagctcgcccaactgcgtgcccatggactcgaaacccgctcgatgacgctcgccgccgccgcgcagtatgtgcgtgcccgcgtgggcagaatcgccgagagtctgctcatcgacaccgcgaacatgggcacgaacacaatcaacgcgcacgtcagatcgcatcgcaaaccgacgcggcccatgcgcctgaacacggtgaatgccgcgctttcatcgctcgaagcgttggcgaggatctcccagaccgacattctcgacgatgcgagtgcgacggccgacccggatcggagcgcgctcgccgaatcggtgaaggcatccgctttatcggatctgcgttcgcaatgggatgcccttgcgagcacggtgcgcgccgcgcatgccgcacaggagcaggccagtggcatcgtcgtggacgattcgcggctgagcgacaccgacaaggtgggcgacggccttgaattcggcattgatgcgttatatctgctccttgcgcaaggtgatgacgagacgctgctcgatgtgctcgaggcgctgtgcggagaccataacgaagacgtgcgcaatttcaatctgctgtggcgcattgtggggcagattgccgacgacctcggctccttgccgtcgaaggcgccccaatacgcgcttgaggcggcatggaaagcgtgccatgtggccgatgcgtggaaggtgcaggccattttcgactcgccggacggccgtgccgccaacgaccggctcgacacggcgatgcggttgttcaactacgtgcaatccgaaggcgtggcccccgacatcaacgctttcatcgaccaggtgcgccagctgcagatcgaggcggattcgctggccagcttggcaccggttgacgaggcggtcacgctcaccacgcctgccggcactgccggactgagctgggagcatgtgtggattcccgccgtgcaacaaggcatctggccgaatctggccgcccgtaacaccatgttcggcggcgaggatttggtggatatcgccctgcacggcagccagacccggcaccgcaacgaggtcggcggccagctcgacgaggtgctggcgtccgagcagaagggctggctggtggcgctcacccgcgccaacggcacattgaacgtgagcgccagccagaatgacgatgccgtgccctccgatttcctgtacgcgtacctgccggaatgcttcacccgtgacgatgccgagcggccattggccgaacggctggccgacgcatccgatgccgggaatgcggattccagaaggaatcagaccgaaacatcggtggacactgctgagcatggccatagcgtgaaggaatcggaacgacatgccggtgacgagaccctcactgcgagcatgcggggtgtgatcgccttggcccgtatgacgttggcccatagtgaggaatcatccgcggaattccaggatgccgtcgccgcattggcggcattggcgtcggcgggagtcgacgaggccgacccgcggcgttggccgttcctgcgcgacgcccccaccggggcgcgatcgccggggcgtcatgagcgcacccaatccgggaacagcgtgcaatccactgggacggcgctcagtctcaacgcgggctcggcacaatccggagcctcgccccaagccatgagtgttccgacggatccgttcgccccgatcgtgctgtcgccctcgcaggtcgaccgactgtgggggtgcgcggtgtgtgctcgcctggaacgcgatttcagcggccccaccccaagcgcggtggtggcggatttcggcacgctcgtgcacgatgccgcgcaatacgcgaccgagcaccattgggatctgccgcaggtctacgaacaattcgtgccgattcaggggccgcataccgacacatggcgtgagcagacggcccaggccatagccgacaggatgttcgacgaatactatgcgccgcggcgcatagacccgctgggcatagaggacgcctcagagcggttcgcggcattgcagcgcgatgctgagtccaaggcgatgctgttcaacatcgcgaggtatttcgtcgattcgaacgaggctgagtacatccataagaccaccggtgccataggcaccttggtcgagtcgttcgcggaatgctccttcgaaggagccttcacgttgcgcagcatcaccgacgcctacaaccatgccggggatcggccaaagctcaccgtgcagcagatgcgggcgatactcggggtgctcatggacggttggcccgtgcaattggccgatgggcaagaggtgcagatcaatggccgcatagaccgcctggaacgccgtcgattcgacaatggtgacgaacattggcgggttgtggactacaagacggggaacagcttctcacccgccgagcagttcagcgatctgcagcttgtgtgctaccagcttgggctggccttcaacaccgatgggtccacgaccgcactcaccgggccacgcccgaaggtgagccgtgccgagctgttcttcgtcaaggaccagccggcgccggcaggcaccgccacacgagtggaatcgtattatcagccggcgctgatggaggggggcgccgtcacggacaccgggttcgcagcacggtactacatgccccacatgagctccctgttcaagatgcagctgccttccaaggctccggacggcgttccggaagaggtgtggcatgacctgctcgccggtgcgcaggagggcacgttgtgggcgttgacgatgcttgcccgcgtgttctatgcggccgcggccaaacaggccgaccacatcgtggcgcatccgacggacgcccataggggagcgtgccgccacaagcaggtatgcgcagcctgcaatgaggcgatggccacggtattcgaaacggaatgggaataggcaggagcgaatatggcacagtcaaacaagccggttccaagcgccgaacagcagcggatcgtcgatgccgatgccaacgccaacgtgattgtggtggcgggtgccggctcgggcaagacgttcaccatgaccgaacgcgtgatccacctgattcacgaaggcgtgcctccggagcatattctgggtctcactttcacgaacaaggccgcctccgagctgctttcgcgagtgtcgaaggcggtgctcgacgatgcgcgtgaacgtgcgagggagggagggccccaccctgcacggctcgccttcatgaaacccgatgtgcgtacctacgatgcgttcttccagtcgatcgtgcgccaatacggattgctggtggggttcgacccgcagacgcagccgctgagcgtcgccggtgcacgccagatcatcgcctcggtggtgggccggcatgtcgacgagatcgtgcaactgccagtggacatgggctcgttcggcacggtggtggatgccgtgggcgcactggcgaacaacatcgcgaattcgatgattggcaatggatgcctcaccgtggccgatgccatcgagcggataacgcaatgggacgcggcgttccgcacgcagatcctcgacctcctgcaaaccgatgaaaccggcctgctcaccgggccgctggcggatcggcaaaggggtgccacgccaaaggcggtgaaggatgtgctcaaagccaggaaaaaggcggagaagaagggcggagagtacgtcgagacccccggcgacaaggacgcagtcggtgaagcgatacatgccgacgccgagttggccgcgcgtgacctctacctggtggcgatgaaacgcgatgtgctgctcgggctcgtgcgtgagttcgacgaggagaaacgccggcggcatatggccgaatacagcgacttcgtgatcgccgcctatcagctggtcgaacggttcccgtcgatcggcgcccactaccggcgtcagttcacccatgtgctgctcgacgagttccaggatacatcgacgacccaatccgcgttgctcgccgcattgttccatgtggacgaaccccatggcaccgaccgcagcgcggccgtgagcgccgtgggcgacccgttccagtcgatctacgcatggcgtggggcctcgcccggtgcattccgcatgttcatcaacgattttcacatgccggccgccgcggagccgttgccgatgacgcgcacacggcgcaactcgcgggtggtgctgcagggggcgaacaacctcaccaaggtgctgcgccgcgtggaacagcgccccagcagcgccaacgcacaggaagtgccggtgcagccgctgcgcaatgtggacgacggcagcgtcgaggtggatgagggcaccttggcggtgcttggcttccagacccgcggacaggaggtcgacgccgtcacacgattcgtgaaacaatccgtggaacagtacggtgatgcctgcaagcccggtgattcgccggtggccgtgctgtttcgcggcaagaagtcgatggccttgtatgaggatcagctgagccaggtgacattgcgcgacggcaggccgttgcgtgtgcgtgccgtgggtctttcagccatgctcgaccgaccggaagtccaggatgtgctggccctgctcaaggtggtgggcgaccacaccgatgccaacgcgttgatgcgcctgcttgccacaccacgctatgctctgggcgccctcgacctcaagcgtctggcccgacgcgccgccgatctgaacaccgaataccgcttccgcacgctcgtggaggcggggctcgcccccgccggcacgccgaagcgcgaatggggcgcattggtgcggcaatacgccaggaatgcgccgaacatggtgtacctgatcgacatgctgttgcgcgacgatgtggaagcgcagctggaagccgccgggctgagcgatgaggggcgtgccggcgtgatgcaggccgtgcgggccatgcaccgcgtgcaggacgagatgtaccagccgcttgcgcaggtgatccacaccgcggtggaggcgttgaacctcgacgtcgacctcatggtggcaagcagtctacgaacggggggagcgccggctccgcgcgatgcagtgcgtgcggcaatcgatgcgctgctcgagacggtgaacacctacacgtcggagatcgcgcaacagcagcgtcctacattacgtgggttcctgacctacctcgacatggcgaatggcagcgatatgccggaggcagccgctgacctcggcgatgaacccgccgatgtggtgctcatgacggtgcatcaatcgaagggattggaatgggacgccgtggccatcgtaggcatgcaacagggcgcattcccctcgaataagggtgacgcattgagggtgaaggcactggaagaccgcgggtcgaaactggattgggagccgccgctctacgaggagacggccaaaagctggctggagagtccagaggcggtcccggtgccgattcgcgtggacgccgccattctgccgaagttccccacgattcccgatgcggggggatccgatgcgtcgagcctgcaggagagcgcggtacgcgcattgcgtgacatcgattcggtggagagcctggagaacgacgcctacggtgaactacgcgcgttgctgcgcgacaatggtgtgctcctcgacgagctgggcgagcccgacgcgtggaacctgtcgcagaaagaggagcgtggtcgtgccctgcatgccgatgagcggcgcctcatgtatgtggcgttgacccgcgccaagcacgatgcattggtcacctacagcgtgggcgccacgacgagccgcataccggaagacaacgccaaggagtcgggcgccccctccgtgttctggcgggaattgcgcgattccatgtcatgcgacgactcgttctcccagcgtgtggaactgaccgcgttcgacaatcagaccaccgcgccggcccggccggttgccgccactgccggcaacaccgccgtgacctacgatgatctggagtccacgcagccgcgctcgctgcatgaacgcggcgccaagagaccggagggcgtcatcgtcgggaagggggccgagcaatttgcgacgcttcttgtggacgaaccctatgaggaacccatggagccgatcgatacggaacagcatctgccatggccaagtcggctgagcgaagagatgcaccgcacactgcggaagggcgcggcacaggtggtgcagcgcatgtcgcaaaacaatccgacagacatgccgggcgaaaccgcggaaggcgacggcagatcgctgctggagcgggcgcgccagctcatcgacaacagggcgacgctgatccgtgaaggcatgacggccgacgagattgagcaggccgtgcgcatgcgcgggcagcgcgtgctggccgccaaagacaaactcacggccaccggtctgcagcgcaatgccgaggcaggcgagaacgccacggatttcgccttggagatcattcgccccgtgccgcaagtgagcacacctcaggcgcaggcgggcacgagattccacgcctgggcacagcggtatctcgaagcgggggtgaacccggaatacggcatctcgcaggaggccatggctcgcgaggtggcgcacgaggcggaagccgtcgaacaggccgagcggggaggtcgtccggtgcccagggagcaacgcgatctgctcatatggaaacagcggttcctcgagtcggcatggtcggcacgtgaaccggccgccgtggagcagaccgtctccactttcgtcagcggcataggcaagcgcgtggatgccaagctcgacgccgtgttccatggcggtcttggcgacggcacgtccggtgcgagtggggatgcgcggtatacgatcatcgactggaaaaccggctcgcggccacgcaatgcacagcagcgcgccggcaagctcgcccagctcgacatgtaccggtatttctgggcgctgcagaaacgcatcccgatgagtcagatcgatgccgccctctactacgtcagcgagaaggacccggcgaaagcgctcgtggtcgcgcctcaacggagcgaggcggaggtgctcgccgagatgcgcgccggcgttcctgaacccgacgataacgattagcgtacgctcacggcgtcaatctacacccgtagttagtgtaggcagtgttttcatgccaacgcacacgactcggcgtgacccatgcgacatgggcatcgggcggcgtgcgtggaacggcggccataggtggcggggaaacgcacgtcacggccttccacgcgtcgtgcatcgttggcgaatatgcgggcgggcgcatatgactgactcgatatgaggagtgatatgagcgacaccaataatcgacatgacaacgttgccagtgcgtcgagcacggcgaaccgcgatctcaccctgcgtgcgatgaccctcggcgacctgcaggatgtggccagggtgttcgacgaggtatggccgcaggctgcaccgttgaccggcacccccatggcgtacgaactggcgaggtacttcgtgctggaatacatgcggtccgccacggcgtcctgcgtggcggtgacggccgacggcgagttcgccggcgtcacgttggcgcgcatcgacgggcagccgttggcgttcccccagacggagggcatgctcggtgacctgcggcagatcatcgacgagaacccgatcgccaagatgatgcgctccggattcgaccatttccgcgccaccgaccaccaactcgaactgcgtagcggggtcgggcagagcacgcaggccgaattgctgctgttcatggtcaatccggcggtcaagggccatggagtgggaggcgcgttgtggaatgcgctgctgcagggcttccgcgcgaacggcgtgcacgcgttctacctgcacaccgacaccagctgcgactacacctattacgaacatcacgggttgcaacgcgtggccgaacggctgcgcgcggatcatccggaagacaacgggcgtgccgatggcattcgcgacgacatgttcgtgtaccggggcgaggtgccggccgtatgagttcgaagccatccaaccttcccaaaacggccgatggggcgacgcaggcggcacaaggctcgggctcgccgtacgcgcggctcttcaggctcaagggggccaaggcgttttgcctctccgccgccttcgcgcgcctgccgatgtcgatgatgagcctggggatcgtgctcgcgctcaatcatctgtacgacaactggaccgtggccggtgcgatgagcgccgtctacattctggccgtcgccgccgtgaccccgttctacgcgcgcctgttcgaccgcttcggccaagtgaaggtgggccgtgtcgcgctcaccgtgcaggtgattgtcatgctcgccttcgccttcgcggcgcttgcccgcgtgccgatcccattgctgttcgtgctcgccgtggtcatgggtgccacccagttctcgttcggcgcactcgtgcgcaccagatggacctacttgctcgaacgcaccgacaacatggatctgctcaacaccgcgtatgcgctcgaagcggcgatcgacgagatcgtgttcattttcggccccattctcgccgccacgctcgccacatcggtgcaccccgtttcgcagctgttcgtgccgaccgccgcctgcgcgatcggcggcggcatcttcttctcgctcagatccacgcaaccgccggtgttgcacgccgtggagacggtgcaggtgaacggtgacgacgacgatgtgcgcatggcacgttccggtttcgccgcccaggcagatggctcgcatgtcgccgggcagcgtgccggtgtggagcgcaagcaccgtggcatggtgagccagtcgcgcaggaccacgcgcaacgtgctgtcgtacgccgggattctgccgttgatgctcgcgttcatctgcttcaacatgagcttcaccactttcgacgtgtcgatgaccggccagatggaggccgaccatctcgaccgcttcctggggctccagctggcaatgatcgccgtcggttcgtgcatcggcgcattctacttcggctcccgccagcatcgcggttcgcattggcgccggctcatcgtgtgcctgtgcattctcaccgtgggcttcatgctgatgcgcgtgacgatggacatctactgggtgcttggcatcgtcgagctgcttgccggcttggtcgtttcgccaatgttcgccacaggcaatctcattgtgaaagacacggtgccggagagccagttgactgagggactctcatggctcaccacggccgggcagatcggcgccgcgatgggttcgctgctcggcggcatggtgctcgaccacatcgatgcgcatgccggtgtgatgacgacgtgggtgtacacgctcgccgcgatccccttcgccgtgctcggctggtatgtcgcctcccgcaaggcgcaggccgtcgacccgaacgcgtgatgcacgccacgaattactcttaggtgcagatgcacacaatcccaagggaggaagtatgattcgagtttccgtggtcggagccaagggacgcatgggttcgcacgtggtcgaggcggtgcgtgccgccgacgacaccgagttggcgctcgcgcttgatgccggcgatgatctgacgcagatcacgccgcagaacaccgatgtggtcgtcgagttcacggtgcccgcggtgagtctgaacaatgtgctcacgctcgtgaggcagggcgtcaacgtcgtcgtcggcaccaccggttggaccgacgagaagctcgaccaggtgcgcgccgcactcgctgagaccgagacaatcgacggtcgcaagcagagcgtgttcattgcgccgaatttcgcgatctccgccgtgcttgcagacgtgttcgcacgcatcgccgccccctatttcgaatccgccgaggtgatcgaactgcatcaccccgacaaggtcgatgcgccgtccggcaccgccatccacaccgcccacgcgattgccgacgcccgcaaggcggccggtctgggtgagatgcccgacaacacgcagaccgacgacggttcccgcggtgcggtgatcgacggtgtgcacgtgcatgcggtgcgtctgcgcggactgaacgcccacgaggaggtgctgctcggcaatgccggcgaacagttggtgattagagcggattccttcgaccgcatctcgttcatgcccggcgtgctgctcgccgtgcgcaaggtcgattccggcgagttcccgggactcaccgtcgggctcgatcaattcctcgacctgtgagcgaacgggcggtacgcgtccgaactagcaagtaccgttgcaattatgagtgacggtattatgcatcttctcgatccggccccgttcggccgcgtattgcccgcgatgatcacaccgatgaagcccaacggcgatgtcgatttcgacatggcccagacggttgccaaacagctggtggccgacggtgccgacggcctcgtggtcaacggcaccaccggtgagtcgccgacgacgcacatggatgagaaggtcgaactcgtcaaggccgtcaaggaagtcgtcgacgtgccggtcatctccggcgccggttcgaacgacaccgcgcataccgtgcgcatggtcgaacagacgcaggaggcgggcgcggatgccgtgctcgtcgtctgcccgtactattcacggccgtcgcagcagggaatcttctgccattaccaggcggtgaacgagtcggccgacaagccgatcatcgtctacgacgtgcctgggcgcaccggtgtgagaatcgcactggacacctacgtgcatctcgcggaactcgaccacgtcaaggccgtcaaggacgccaccggagacatcgccggagcggtacgcaagcgcatggagaccggtctcacttggtattcgggggacgacgcactgtatctgccgttcctatcgatcggtgcggtgggcatcatctcggtggtggcccatgccgctgccaaaccgatgcgcgagctcgccgaagcgttcgaccgcggcgacatcgccaaggcacagggcctggcgaaccgcatcgcgccggtcatcgaggcgatgaacggcaccgggttccaggcggtcatggcaaaggcggcgctcaaggtgcgcggcatcatggaatgcacaacaatgcgtctgccgaacatcgggccgaacgacgaacagatcgaagtcgtacgcgacggcctgcgggcatccggtctcattccggaatgatccgcacacaacggttgcccaagcggcagccgttggtttttatacctcgccgattgcaaaggcaacggcaataatcaaggaaatgcgaagagaaagtagcatggcaacacaagaagcaaagacaacgaggaaacgctccgcaggaaaatccgcaaccggcacgaagcgccgcagcactaagtcggcggccagccaggcgaagagcccgcgcacgcgcaagtccacccgcaatacgtccacacgggtgaggaagcagatcaacgtgaacaagccgctcgccacgagcgacacgcaggacgagaaccgcgtcgcaccgccgaagtaccgcaagggctcgatgcgcatcgtgccgctcggcggtctgggtgagatcggccgcaacatgaatgtgatcgaatacaacggccacattttgctcatcgactgcggtgtgctgttcccggaagaggagcagccgggcgtcgacctcattctgcctgacttcaactacatcaaggaccgtctcgataaggtggatgcgctggtgctcacgcacggccatgaagaccacatcggcggcgtgccgtatctgctcaagatgcgtccggacattccgctcatcggttcgaagctcacgctcggattcgtggaggcgaagtgcagggaacaccgcatcgagccggtgatgacgcaggtcgaaggccgtgacaagctcaaggtgggtccgttcaacctcgaattcgtctcggtgacgcattcgattccggacgcgctcgccgtgtgcgtgcgcacgccggccggctcgctcatcgacaccggtgacatcaaactcgaccagctgccgctcgaccaccgcgtcaccgatctcgtggagttcggcaagctcggcgaacagggcatcgacctgctgatgatggattcgacgaacgccgaggttcccgggttcgtgaagccggagacctcgatcggcccggcactcgaccaggtgttcgccaccgcgacgcgcaagatcatcgtcgccagcttctcgagccacgtgcaccgcgtgcagcaggtggtggacgccgcccacaagtatggccgcaaagtcgtgttcgtcggccgttcgatggtgcgcaacatggccatcgccgccgatctgggctacctgcacctgcctgaggacacggtgatcgacgtcaagaaagccaaggactaccccgacaacaagctcgtgtacatgtgcacgggttcgcagggtgagccgatggccgcgctcggccgcatcgccgacggcaaccaccgcgacatcacgatcaacgagttcgacacggtgattctcgccagctcgctcatcccgggcaatgaacacggcgtgtacaaggtgatcaacaagctcgtacagctcggcgcgcgcgtggtcaaccgcgacaacgcggcggtgcacgtctccggccactgcaacgagggcgagctgttgtacatgtacaacattgtcaagccgaggaacgcgatgccgatccacggcgagaaccgccatctcgtggccaacggcctgatcgccgtgaagaccggcatcgagcccgagaacgtcgtgctcgccgaggacggcgacgtcgtcgacctctaccacggcaaggccgccatcgtcggctccgtgccctgcggttacatctatgtggacggcgattcggtgggcgagctcaccgacgaggagctcgagaagcgccgcattctcggcaccgagggcttcgtgtcatgcttcgccgtcgtcgacacggacgcggccgaggtggtctccggaccgaaggtgtacctcaacgccgttgctgaagacgaaagcgagttcgagaaggtgcgtcaccagatcgtcgagcagctgcgcgacgcgatgatgacgggcacgaaagacacgcacaagctccagcagatcatgcgccgcacgctcggcggctgggtttcgcgcgagctcaagcgcaagccgatgatcgtgccggtcgtggcggatgtcgccgccgacatgaacaagatggagtcgtacaacgactgagcggccgtacgcgacgcccgattcgcccaaggcgtggaccgaagtctcacgtccggcggaccgggcgccgtttgccatgtgcggcgagcggaatccgaccagattcatatagagtagtactaagcataggaaacacagagcagtaaaggagaatccatgccgggatcgaatctcacccgagtggaagcgcaggagcgcaaggcgatcatcacctatccaatcgaatacacggtggatctggacttgacgcagggcccgaagaccttcgtctccacctccacgatccgcttcggcgcccatgccggggaaagcacgttcctcgacctcatcgccgactccgtggaatcggtgacggtgaacggcgagacactcgacgtgaacgaggtgttcgacgacgaccgcatcgacctgaacaacctcaaggagcacaacgaggtcgtggtgaaggcggtctgccgttactccaccaccggcgagggcctgcaccgcagcgtcgacccgtccgacggcaatgtgtacctgtattcgcagttcgaggtgccggatgcgcgccgcgtctacgccgtattcgaccagcccgacctgaaggccacgttcaagttcagcgtgaaggccccacagtcgtggaccgtgctgtcaaacatgccggtggaatccaccgaggacctggccgacctcaccgccgacggcacgctggcaggcaagccggccgagagcacgaaactgtggcatttcgccaccacccccacgatgagctcgtatctgacggccatctgcgccggcccctacgccgcctggcacaccacctacgagaacgaggacggacgcaccgtgccaatgagccagtactgccgccaggcgctcaaagacgcgttcgccaaggacgtcgactacctgttcgacatcacgaagaagggcttcgccttctacgccaagacctggggcgtgccatacccgtatgcgaagtacgaccagatctatgtgccggaatacaacgccggcgcaatggagaacatcggcctcgtcacgatccgcgattcgtacgtcttcgagtcgaaggtgaccgacgcactcgccgagcgccgtgtggtcaccgtgctgcacgagctcgcccacatgtggttcggcgactatgtgacgatgaagtggtggaacgacctgtggctcaacgaatccttcgccgagttcacctccacgctcgccaccgccgaggccaccgattggaaggacgcctgggccacgttctgctcgggcgagaagagctgggcactggcacaagaccagctgagcacgacgcacccgatcgtcgcgccaatcaacgacctcaacgacacgtacgtgaacttcgacggcatcacctatgcgaagggcgcctccgtgctgaagcagctcgtcgcatacgtgggccgcgagcggttcttcgagggcatcagccattacctcaaccgccacgcctactcgaatgcaacattgaacgacctgctcgacgaactcgaggccacctcgggccgcgacctgaagacctggagcgccaagtggctcgaacaggcgggcatcaacacgatcagcaccgctgttcaggccgatgccgacggcaagatcacgtcgctcacactcacgcaggccgcgccgaccgagttcccggtgctgcgcccgcaccgcctggccgtcggcttctacgatgaagacccgcagaccggcaagatcgtgcgcaccgaccgcatcgaactcgatgtggacggcgaacacaccacggtggcacaggcggccggaaaggcaaagccgtcactgctgctcgccaacgacgacgacctcacctacacaaagcttcgtttcgacgacgacagcctcgccttcgccatggcgaacctgtaccgcttcgacgatgcgctcgcccgtgccgtgatctggctgtcgctgtgggacatgacgcgcgacggtgagctggccgccaccgacttcatcgacacgacgctcaagatgctcggcaccgaaaccgagtcgacgacgttccggtatgcgctcgccatgctttcaacgaccgtctggcattacaccgacgccaagcagcgcaatcggatcgccaagcatgtggccagcgaactgttcgcgctcgccaagcaggccaaggcaggctccgacgagcagttccagctcgtgagcgcctacctcacctatggcgtggaaggcgacagcgagttcgccgacaccgtgcgtggcttgctctccggttcgctcgtgttcgaaggactcgagctcgacaacaacttccgttggtcgatcatgcacgcgctcgcttcaatcaatgcgatcaagcaggcagacatcgacgccgagctcaagcgtcgcgacaccacggagaaccgcgagttcgccgtgggcacgcgcgcctcgctgcacagcaaggaatcgaaggactgggcgttcgaccaggcgctgcacaacgacgagctgaccaacagccagctcggggaggtggctcgcggcttctccggcacccatgacgccgatctcgccgacggttatgtggatgcctacttcgaggcaatcgactggatctggaagaacaagaccttccatatgagcgaagtgctcattggcgacctgtacccggcatacgccgacccggccaagctcgtcgaagcaggcgaccgttggctcgccgcgcatcaggatgccgacaacgcgctgctgcgcatggtcaaggccaatgtcgaggcatcgcatcgcacccgtatggtgagcgatttcaacgcgtcgattggtgaatccgcccggtgatgtgctgggcatgggaggggatgggccgcgggactcatcccctccgtattgttgatattcggcggatacggcaagtcagtgaatagtctcagaatagtctcatgactcatttgggacttcgaacgtgacagacacgtgcatcgacgcacggattaatcatatctggaagcccccaatgcgacgaagacgtgcgtgcatatacgggaatgtagcgcaaggagtctgcaaatatgacaactctgtgtgcaagcgcatgtgttcgtcatatggagggacatggagatgagacgaataagatcatattcgcacgtatgtaacgcatcagggtgtgccacagacggcaaacgcatacttgcgcacacgggtacagctcatccatgacgaatgatgcgcggtgaaaggggcactggtgacgtagactggaacggaatataggaatgcgcgaaatggaatagaggatgtatatgccgcgtatgtttggaaccgatggtgttcgagggcttgccaatcgggatctcaccgcccagttggccttggatttgggggacgcggcggtccgtgtgctcggcgacgacggtggtcgcgagacgaaccggcaccgtgcgctgatcggccgtgacacacgtgtttccggcgactttctttcgcatgctctggctgccggcatgagcgccggcggattcgacgtgatcgacgccgggatcattcccacgccgggtgtcgccttcctcaccagcgtgctcaatgtggagatgggtgccgtgatttccgcctcgcacaatccgatgcccgacaacggcatcaagttcttcgcgcgcggtgggttcaaactgcccgacacgaaggaagacgagatcgaggccgtgctcggccaggactgggagcgtcccacaggcgccggtgtggggcgtgtgagccacgatacgacgaccgcgacgaacctgtacattgaccaccttgtctcggcgatcgccccggaaggcaacgagcagccgctcaagggcctcaaagtggtggccgactgcgctaacggcgccacctcggtggtggccccggaggcgttgcgtcgcgcaggcgccgacgtcattgtgatcaacgcctcgccggacggctacaacatcaacaagaacgccggctccacgcacccggagtcgatgcaggcgatggtgagggcctcgggcgccgacctcggcgtggccttcgacggtgacgccgaccgctgcctggccgccgatgccgaaggcaacatggtcaacggcgaccagatcatgggcattctcgcccgtgccaagaagcgcgagggcaagctcaaccacgacacgctcgtcgtgaccgtcatgagcaatctggggctcaagctcgcattgaaagagatgggcatcgacaccgtgcagacgaacgtcggcgatcggtatgtgctcgaggagatgctgcgcggcgactacagcctgggcggcgaacagtccggccatgtgatcaaccgcgagttcgcgaccacgggtgatggcacgctcaccgcgctcacactgtgcaacgaggtggtgaagtcgggcaagtccctcaaggagctcgccgccgacttcccgcagctgccgcagcagctcatcaacgtgccgaatgtcgacaagatggcggccaagacgaacaaggccgtgctcgaagccgtcgcccgcgaggaggagctgctcggcgatacgggccgtgtgctgctgcggccgtccggcaccgaaccgctcgtgcgtgtgatggccgaggccgccacgcaggaacaggccgacgaggtcactgcgcgtctggcgcagatcgtcgccgacgagctcgcattgtgagcgcacgtcaatcagcgaattccagaaaggtctgaacatgttcggaaagaagaaccatgtcgacatcgagctcaatgcggatgtcgaacgtctgctcaagtccgcgaaggaaggcgtgctgcccatagtcgaagcgggcgagcccgtgctgcgtgagcagtgcgtgcgctacgacggccagctgagcaagcatacgctgcacaagctcatcgagacgatgcacaagaccatgctcgacgcgcctggagtgggtctggccggtccgcagatcggcctcaatcttgccattgcagtggtggaggaccacgcgaacggtgatgatgacggcgatccgcgcgagatagcggagttcccgttccacgcgattatcaatcccgtctatcgcccggcaggtgaggagacgcgctccttctacgaagggtgcctgagcttcgacggctaccaggcggtgcgcaaacgctacctcgacatcatcgcgcattggcatgatgaggacggcaaggaacatgaggaacacctgcatggctggccggcgcgcatcttccagcatgagaccgaccatttgagcggcgagctgtacatagaccaggcggagatccgctcgctcaccacggtcgagaatctcgaggacttctgggcgcaggatccggtgcccacgcaggcggccaaggagcttggcttcgagctgtgaggaagaggttatccacggggctgtccacatgcggtgggcggccccgtttcgtcatccacaggtgcacgaatgcgccgagatatccacaacgcctccccgtgctacacaatcgggcatgattggcctacgatgaacacatgacctacgaacagaatacgcagtggctcgaggcgagcaaacacgacgtgacgcaatgggcggccgtgatggagcgcgacgccgacgaacgcatcatcgattgggattgggtgtgctcgctcgacttcgttgcgggcgtgggtgccggagcccgactcgacctggtgcatgacgagtacgacgcgcatgccctgctcatgcaggactatgcgattcgcgagcggctcgaggcgattctcgagaacgtgacgagcgtgttcatgggcgacttcgaccgcaatctcgattcgttccggctcgcccgcgcgcttgcgtacgccaatcgcaggctcaacgacgagatcacgctgatcatggagcagggcaaggtgcgcagattgtggaatgtggagcgcagattcgagcggggcaccgccttcgttgtgctgcacggcaatgaggacgcccatgcgaacgagatcgtggaccgttccgcccaacttgcgcaggagcgcgcgcaacggcgcaaccatgcgatgaaccagcgcaaggcggggtcgcagatgatgcagcaggcgagtctgtcgtcattcaccgacgacaaggtgctgtccgaggaatcggggcagacgagccgtccggcggctccaagacgttcggacagccagtatgactggcgcatggcatatctgccgggacgcgatgtggacgcggtgctcggcatagacatagagaccacgggcacaagcgcatggcgcgactacatcatcgacgtaggcttcgagcgcatgaatctgcaaacgccggcgccggagggggcgaaagcacgtgacgtctacagcgagaccgactatgccgcggatggtgcatacgatcagtcgcgcctgtcgttcggcgtgccgctgcgctgtgccgaggtggcgaacccgttcatcgcgcagctgacgggcattgacgtgacgaaaatcgcgggcgagcccatcttcgacgaatggccgcgcatgcagcaggcgttgctggaacggctcatgcaacaaccgtatgtggcgcacaacgccaccttcgaacaccggttcttcatggcgaacgtggaaggctacgccgaggcataccgcaacggcgagatcaccattctcgacacgatgccgatgagccgccattgggatgccggctccgttccctcgcccggccacccgcacggcgacaacaccctggaagcatatgcgaaacgtcaaggagcgcttgacggcaacagccatgaacggcatttggggctggaagacgcccatatcatgctcgtggcgatgcgccaccacctgggcacgctcaaggtagctggcgaaggcccatggggtccggcaggccgtggaggcgtgggaggcaagcacaccggacggcgccgctgagcccagacgccctgcggcacccatgccgatgcgtcaccacagcagcagcgcgagatcctccttggcctcggggaaatgctcgacgtattcgacggcctcctcgaccatgtcttcggcgatgagcatctgctcgtagatcacgttgcgcgcgtagcgcccttcgccgttcgcatattcctcgacgatctggcgcacctgctcgtcccagtcgccctcctcgctgcatagggcgttgagattcgccaatgcgcgcgtatcgctcgggtcgtaggcctcgacgatgcgttcgcggtagatgcgcttgagctcgtcgcggttgtcgatgccctgcagcgcgatctctcggatcgaatcccactggtatggcaccagcgtctccgggaacagcatgatctgctggttcggccgttcgcgttcgatgcggatcgccagactcaacagttcatggaagcgcttcgtgctgatgagccgaagcgccagcatatcggccagcggttccatgtcggtgtggtcgcgcagcaactcgtcggccgccgcatcgtcgccgctgatgcgcagcaggtcgtggcgcaggaactgcactgcctgttcgaactgctcacgtgcgtagatatgcagacggcggttgaaggcctctggatccaatgtcagattcagcgccatctcatcgtccgaatcggcgtgcggcactacgatgccgaggtcgtcgtcggcatcgaactcggcggccatcatctgctcgaactgctcgttcacttgggcaatgtcgtcggtgggagcggcctgtgcatgcgggtcgcttctgttgggcgatgccccgtcgtcggcgtttctggcatgcgaggagccggacggggtgtcgaaattatccatctcgtcgagattcgcgcgcatgtagtccactgcgcgttccagcgactcgtaggcgagcacgcgtgtgtcgtcgtagctggcgaaggagagcgtgcacgagagcagctcgatcatcttcgtggcgttcaaatgaaagtatttgctgcaggcgacgtcggtgatgcggcgcagcgcggtggccgcgacgtccgggctcgcattgcgggccacggaatccatgtacacctgcacctgcatgatcgtgtcttcgaggaagtccaggccctcgttgtcgcggtcggcgcagttgttgaggaactcggcggtgatttcgagcgcgcgtgccagattgttcacagcgtcgagccaatggttgctcgccaccgcgttgcccaccacgcagctcaccccctgcagtgcctgcgaatcaatgcggaaggtgggcatatcgcgaagcggcatctcgatgccgtcacccgtgcgttgcgcacccggcacaatggcggcgagcgagtcgaaataccattgcatcgacagcgtcatcaccgtctccgcttcgtccgtgggcgccaccggcgtgcccagacgctcggcgtcgtcgtcacgcgactcctcgcagattgaggaatcccaaaggaacgtgggcgcatgcagatcgtcgttgttcaggcagctcgtgccaatgaaatcctcaatatcgtacagttcgttgtaatacaccggctgggtgtgtcgattacgtaatcccacggtgcctccttatgtttccctccaccatattgttgttccatactgtcacggttgcatgaatcgtccgcgaaacggtatgcgaacggcgaagtctgctcactatgtgaaggaatcgtgtgcgttcggcgatccgcgggaccggtgataatggttgcgtgggcacatctgcagattctggcgattccaaatacgcgcgaggcacgcgcagctacacgatgtcgcgcattcgcggcaaggacacgtcaatagagcggctcgtgcgcagctatctgttcgcacggggattccgattccgcaagaacgacaggcgttacccgggccatcccgacatcgtgctgccgaaataccacacaatcgtcttcgtgaacggctgcttctggcatatgcatgaaggttgcccgaaattcaagatgccggggtcgaacgtgggattctggacggccaagctcacgcgcaaccgcgagcgcgacggagcccagcacgagcagctgcgggccatgggctggcgggtgatcgacgtatgggaatgcgagctggaacggcagtcgcgtgacgcgcgcctgcaatcgctggcatcgcagattctggatgcgcccgtagagggagcggttgaaaacggcggcgaaacggcagatactgggcaacagtgagcagctcagggcgaaggagtgtcatatgacaggtgcagacgaacagacgaaggattcgcaacggcagaacatgcggccgccgtttgcgaaacgcgcggcattggccaggccgttcatgggcatgcgaatcagcaatgaggcgaagcgtctgcgcgcgcaaggtgtcgatgtgatcaacctcagtctggggcaacccgattacggtgcgccggaaccagtgcgtgaggcgatgcgcgacctgtatgacggccgtccactgccgtactcggattccatgggattgtcggaactccgtgaggcgatcgcgcggttctaccggacggcgcatgacgtcgaagtcgatccgaaacgcatcgtgatcaccgaaggaggttcggcggcactgctgctggcgaccgcattgagcgtcgacgagggcgacgaggtgatcatcgcagacccgtcgtacccgtcgaaccgcgagctggtgcggtccttcggcggcaaggtggtcgacgtgcccacgtccgcggcgacgcgcttccacctcgatcagccgctcgtccggcaatactggagcgagcgcacacgcgcggtgatgatcacgtcgccctccaaccccaccggtaccacgatcgcgcccgacgtattgcgtgacgtatgcgcgtacgcggcacaccatggtgcatggcgcattatggacgagacctatttggacctgaccgacgtggaggcagacggcagccgtgtggagtcggcgctcgccgtcgaccctgaagccatggtgtgcggcagtttctcgaaattcttcggcatgaccggctggcgtttggggtggatggtggttcccgagttcgctttggatgcggtggacaatctggccacgaacttcttcctcggcgcccatacgccgtcgcagtacgccgcattggcctgcttcacaccgcagtcgctgcgcatatgcgaggagcgccggcaggaactgctggaacgccgggcattcgtggtggacgctctcgcccgcatcggactgccgttggaagtggtgccgaacggagcgttctacgcgtatttcaacatcagctccaccggcctcgatgcgcagaccttctgcgaacgcgcgttgcatgaggcccatgtggcgttgacgccgggcggtgatttcggacctgccaccggcagcacgcatgtacggctctcctatgccgcatcgatgagcgatctggaggtcggattcgagcgtctgggcgatttcgtggcctcgttgcgccgttgaatgggcacgactcggctacaactgttcgagggactcgagctgggcgcgggccttgcgcagcttggcatgcgcctcgttgcgccgctcctgcgtcttcgccctggcatggtcgccctccagtttggcgatctgcgtgcgcaattgggcgattctgctcgcgcgtacgatacgcgcgtcgagatcggcgaaatccgtgctgccgaagatcacctgcgaacacagcgaatcccacaggtcgtcggtggtggcagcggcatccgcaatctccagcagggcttctccggagggaatccatgcgctcgcgaattcatggaatgtgggtgcatgcccactgcgttcgctcaatgggcgacgcacgacgaaacatgcttcctcgcgcatggcgccttcgaattccacgttgcgcacgcagacgaacacgatgcccgatttgcgctgtgcctgaatgagctcgacgatgtcatgcggcgcctcctcgatgccgtcggcgagccgcaggccgattaccagtacttcgggaatccggcgcccctgttccacgcctgtgtttgcggcgcgcagaatggcgagcatcgtgatgccgtcgatggcgtggatgagatgctgcttcgttttcgccgagacggccactttcgccacgaacatgcctttcggcagcgttcccctggactcgggaaccgcgcaggaacgggggagtgcgagcgtcagtgcgctcagcgtgccgcaatgtgcctcaatcgccatgccagcctctttcgtcggcgtgttttctagcgactctactgcatggcgggcgcgcggcacgcgtgtatctcgaatttacggcatgcgacgtcggaaaaacaaagtgccccagacgcgattcgaacgcgcgacacccgctttaggagagcggtgctctatccactgagctaccagggcaacgaatgaccattatacaacacgacgcacggtattcaacacggcgaaccgatttcaagcgaaatcatctcatcggatatgccgctcgtgacacgcatcggctaggcttggcacgcagaagcggaaaatggccgggagggcggtcgagccggcgacaagggaatggagcatatatatggcgatgatgcgcaaacacagggtgttgggggctattgccggcttattggcgttggcgtcgctctgcagctgtgcgttgcggttgctgccggttgatttgcagacgttgccatacgtgtctgtcgtgctcgccgccacgccatggttcgccattgtgtcggtggtgtcattggtgttggcgttgatctccacgcgctgggtcaccgcgattgtggccggcgtatgcctggcgatccaggtgtgctggcagctgccgttctaccataacggcaccccgctttcgggaagcgcgctgtcttcacagtcgctgccgcgtgccgacactgccgacgccgtggcgcgcctgatgacctgcaatgtgtacaaggggcatgccgatgccgccgcaatcgtgaacgccgtgcgcgacaaccatgtggaggtgttggcgttgcaggagaccacgccggacttcctcaagcgccttgaggaggccggcatctcgcagctgctgccgtattcgcagacctcgagcgccgatggctatttcggcaacgcgctgttctccgcgctgccgttcgagaatccgagccagaccgacgtcgattccatcgcctcctatatgcccggcggcacagtgggcttcgacaacggggcgattccggtgcggttcgtctccgtgcacacgcagtcgcccacggagggcagattcgagaaatggagcaggtcgatcgccgagctcaagcagctcaacgaacaccctgacaccgactatattctgatgggagatttcaactccacttgggaccacgccgtgttccgcgacatgctcggcacccgtttccaggatgccgccgaggtgagtggccacggactggtgttcacctggccggcagacaggaagtacctgcccgcgttcgccggaatcgaccacatcgtgacgagcaaggacgtgaccatcgggcaggtcaactcgctgacgatccccggttcggaccaccgcgcgctgctcgccacggtggacgtctccggcctgcgtcactgatcaggattccagattcgactgggtccccgccgtgttcgccgtctgcgcctgcgcctgttgggcggcgtcgagcttggcgcgaatggtgctcagcaacgactgtgcgcgctgtgcgagtgcttcaccgagctcccattgcttcatggagtcctcaaggctcaggcctccgttctcaagtgcacgcaccgcttggatgagctcatcgcgtgcctgctcgtacggcagctgtgcgatgcgctcacgctcctcctgactcaggctcgatgcggtctgcggttcggtttcgctcacttcggtgatctccatgtcttccgccatgtcattcctcccgttcggtattcgtttccttggtgttcgtctttcactcatcgtagacggcctgtgcttgcgagacgaccttgccgcgacgcagggtgagtgtgagctcgtcgcccacctgcacctgcgaggcgtcgtcgatgatcgcgccatcggcgttctgcagcaccgcatagccgcggtcgagcgtggattgcgggctcagcgcgcgcagggtcgcggcgagtctctccacctgcatctgctcctcgtccacaatacggcgcaaaccgttgcgcatggcgctcaccgcgtccgctatgtcgcgttcgtggggaatgagcatggtgagcggctgggtcagcgacggccggttcgcatagccttcgacgaggcgctcctcgttgcccgcgcgattcgcgatgaacgtgcgcatgcgattgatgccctcggtgatgagctgctgctgctcgcgcacgtccggcacgacgcgcttggcggcatcggtcggtgtggaggcgcgtacatcggccgccagatcgatgagcgtccagtcgtcctcatggccgatcgccgagatgatcggcgtcgcgcaggccgccgtggcgcgcaccacgcgttcgtcggagaaccccatgaggtcctcgaagctgccgccgccgcgcgcgacgatgatcacgtccacattcgggtcggcgtcgagttgctggatcgccgagacgatgtccggcgggcattgctcgccctgcacatgagcgtgcacaatcgtgaaccgcacgccgggccagcgcaggttcacgttcatcaccacgtcgccttccgcgcgtgcctgcggggcgcagatcagcccgatgttcttcggaaactccggcaatgccaccttgcggctctcatcaaataggccctcgcccttgagtcgcatgcgcagttggttgatctgctcctgcagattgccggcacccacgcgcttgatcatgtcggcgcgcaggctcaaccgtgtgctcttcacgtacagatcggccttgccgtgcaccactacgcgatcgccctgcttgtagtcgcgcgccatctgggcgaaggcaccgaagccgagcacgctcatcgagacgtcctggtcgttgtcgcgcaacgtgagataggccgatcctgagcgtcgtgtgttgatttcgatgatctggccctccatccacacggcgggccatcgttcaaccgcgctgtggaacttctggctcaccatgctcaccggccatggattctccgcggtcgtctgcgccgccatgcgcggcagctcattcggcccggccgctggcgcgggtgcatagccctgtcgatacccggtttggtatccgttgttgaaaaccatgagtctagattcctcccgttcgcgaatttagtaaagcccgctcccgcagcgtgtcgcgaatcgcaatctcaggacgactgaaacacgccgaaacacgccgcagtttcgaacggttcacgccatccaggcatctcacgcgagtggcgtaatccgaaaaaacgtgagttttctcacacatcgatttttggtcggatttccaaggaaagcacaacatgttggtcttttgcgcggcgtttcgtactacatctagtgtcggctatttgtgtaagctcgtagaggcgaatgagatggcagtcacgtctgcgtgattgcaacctgaatcacaatacatgagcgaaagcgttctggaggtatcgatggagactcagattctgggtgacacactgagccggaccgttgttggtgatggcgacgatgtgttcgagggcatgttcactgacagggtgctggttgagaagcgcgatggccgcgtggtcgacttcgatccggtcaatatcgtggttgccgtgaagtctgcgttcgccgatctcgacaaggaggtcggtccgcaggaggagcgcatgatcctcgacatcgcgaaccagatcgaaggcgagatccgcgaacgctacaacggccctgcgaagatcgaagacatccagaacctggtggagcacgcgctcatcgaggaccatctgtacgaggtggcgcgcacctacacgaactaccgcctgaacaaagacatccaacgtgccaaggccaccgatatcaacgaagcggtgagccgtttggtcaaccgcgacgaatcgctggtgcgcgagaacgcaaacaaggactccaacgtctatgccacgcagcgcgatctgctcgccggcgccgtctcgaaagcctcggccttctcgatgctgcctgacgccgtcgccaacgcgcatatgaagggcgatattcacttccatgatgcggattactcgccgttcacatcgatgaacaactgttcgctgcccgatttcggcgatatgctcaagcacggcttcgccctcggcaacgcgatgatggactcgccgaagtcgatcggcaccgcctcgacgcagatcacgcagatcatcaaagacatcgccggtgcccagtacggcggccagaccgtcaaccgcgccgacgagatgctcgaggagtacgccaagcgcgactatgtgaagaacctcgacatggcgcacgcgatgatcccggattccacgccgatcgaggtcgcccgcgacatggtggccggactcaaggcgcaggagccgcgctggctgcatttcgagaaccgcgagccgctgccggccgacgaggccttcgacacgaacgccccggaactcgagcagattcgtgagatctatgcgaagatcatgacgcgcaaggcgatctatgacgccatgcagaccatggaataccagatcaactcgaaccgtgtctcgaacggccagaccccgttcgtcaccgtcggtttcggtctcggcatgagctggttcgcccgtgagatccagcgcgccattctgctcaaccgcatccgtggactgggcaaggagcgccacaccgcgatcttcccgaagctcgtgttcaccgtcaagcacggtgtgaacgccgacgagggtgacccgaactacgacctgaagcagctggccctcgaatgcgccacgaagcgcatgtaccccgacgtcgtgttctacgacaacatcgtgaagatcaccggatcgttcaaggcgccgatgggctgccgttcgttcctgcagggttggatcgacccgaagaccggcaaggacgttgaggacggccgcatgaacctcggcgtcgtgaccgtgaacgtgccgcgcatcgcactcgaatcccatggcgacgtcgagcgtttctggaagatcttcgacgagcgcatggaggtggcgcaccaggccctgcagttccgcatcatgcgttgcaagcaggccacgccggtgaacgccccgacgctgttccgctacggtgctttcggccgcctggagaccaacgagaacgtcgaccagctgttccgcaacgagcgtgccaccgtctcactcggctacatcggcctgtatgaggccacggccgtgttctttggcaaggattggatgcgtgaccacgcatgggatccggagggcaaggacttcgccctctccatcgtgcgccgcatgaacgagctgtgcaagcagtggagcaaggccgaaggctaccattattcggtgtattcgacgccggccgagtcactcaccgaccgcttcaaccgcatggatcgcaagaagttcggcaaggtcgagggcgtcaccgaccacgacttctacacgaactcgttccattacccggtatggctgcagccgacgccaatggagaagctcgactacgagaaggacttcccgtactacgcctccggcggcttcatcaactactgcgagttcccgtgcctgcaggccaacccgaaggcgctcgaggccgtgtgggattacgcctacaacatcggcatcggttacctcggcacgaacacgccgatcgaccattgcttcgtctgcggtttcgaaggtgacttcgcgccgacggaggagggcttcaagtgccccgaatgcggcaattccgaccccgacaagtgcaatgtgaccaagcgcacttgcggatacctgggcaaccctgtgcagcgcccgatggtgcatggccgtcacgaggagatcgcccaccgcgtcaagcacatggccggcgagaccgggcatgtcacgctcgccgacggcgagacgcgcgaatggttcgaggagaccaagtaagcatcaccgatcatgagaaggcgggcctgcgggtccgccttctcgttgtgtcctacgtttgtatggtcctttgtttgcgtaatttgggacagccgaaggcgcctatctgtcccttcttacgcaggcgttttcatttgcgtaatttgggacatccaagtgcccaaatctgtccctttttacgtaaggggaggtgttacgcaggggagatgcagggtacgcaagcgaacgaacgcgagtcgatggggcacatatcgcatcaacggcacatatacgggacgcatctaccacgtgtaccgaggcgtatccaccacatatgcttggatggcagggaaggagctggcatggcagaggctgcaaatatgaatgattccgcgaacggcacgtggcgaagcacggggaagccgagactgcacgactttgcggccggtgagacggggcgcgggccggcgatcccgacgccgatgtcgaacaatccgaagcctggtcagtggacgaatcgcatgagtcacaacatgatcgccgactacaagcgcttcctcatgaccgacggcgaaggcatccgctgctcgctgtacgtctccggctgcccgttccactgcgtggagtgctacaactcgtcaatctgggatttccaggccggtcacgaatacaacgacaagctcgaggcgcagatcatggacgacctggcgcagagcttcgtgcagggcatcacgttcctcggcggcgaaccactgctcaacaccggcgtgctgctgccgctcgcgcgcaagatccgcgagcgtttcggccatacgaaagacatctggtgctggaccggctacacatgggaggagctcatgcgcgacggcgagacgcaagacaagctcgacctgcttcatgaaatcgacattctcgttgacggccgctatatcaagacgttgcacgattcactgctgcagttccgcggttcgcgcaaccagcgcattctcgacgtgcaggagtcgttcaggcagggcaagccggtggtgtgggcgaaactgcacgaccaggagcgtttcattcccgaaatctacggcaaggagcgtgccgccggcgaaggcgacgccagctagtccgctttctgcgcctgccggtcaatccacgcgttcaccgcgttcgtcgcctcgtcgagcgtggcctgcgccgccttgtaatagcgagaatccttgatgcccgactcgtcgaatttctcctgggcgaggtcgagcgccgcttcgaatcctgcggtgagctgcctaccgaccgcggaatccgcataccgctgcttgagcgtgtcgagcagcgcgcgcccctggtctatggcctcctgcagattcctcttggcctgcgcgacgtcctcggtatcggaagacgccgcagattccgactcgtcgccagtgttatctgtgtctgcagaggcaccgcgcacgatctgcgcggtcgatttgcgcaatgattcggttgcactgttcagcgtgttcgccacgagattgagctgtatgatcgtcgcgttcgccgcacacccctgctgtgccacggtgccctccgccgcgctcgccgcatcggctgccgcgtcgagaatcttgtcgacgccgagcgcattacgcaccagcttctgcaacgccggcgaatcgctcgtcgtgtcaagcagcgccttgcgtgcctcgctgaactcgctgaccgccgtctggcagcgcgcatacgcctcgtcatgcttgttcttgtagatgatgccgccgaccacgccgcccacgatcgccaccacggtgatgattgccacgactacaggccacctcctcctacgcttgcctccatccccgctctctggttgataattcgcctgctgataggagggcgcctgataactcggcggcgcatacccctgctgcattggaatctgcgtggtgggcatgtcaatccgctgcgtcggtcgctcgacgttggaatcgctcatcgtgcacctcgtttcagtcgaagaatctgcaatcatcttacctataatcagatgtgcagattcctacgccgcaacgagtgtgggagactcacgcgaacaggatgagggccacgagcaaggcgatgagcgtgagggcggggaagaagatttgcttgatggcagccgaatgcttgtctggcgcggtgcacagcagcacgagcgcggcgcagaacatcgaggcggagccggcggtcatgagtgtcacgcctaccacggtcacgccgcaccataggacgatggcgccgccaatggacatgatggccagaaacaggttgtagaagccttggttgaaagccatttccttggtctgttcagcttcgtcggcacccatcgagaaggtctctcgggtgctgcgtgacgtccacaggaacgattccatcacgaagatgtagacatgcagcaggcccgccagcatagcgaagatggaggccgtgatcaatgcggtgttcattgcttgtctccttcgtcggcttcctttgcggcttgcttcgcagcttctatggcggccaaatactcttccgctgaaccccctacggcggcgacgtcgtctggcgtggccatgccgttgttcgccagcgcgtccttcttgattttcacctgcatgcggcgctcggccgaggcgcttttgaggaataggaacatggcggcggccagtgtgaacaccagcatggccggcggccaaatggtcagtgtgatcattatgcccacgatcttgattgcgaggtcccaggacaacacattgccagccaccaagctcgtcgaatacgggatgagcgagcagaagaacaatagtgtgatgctcgtccacaacaccggctggtcgacgagcttaacgccgctccattcgatgtgcaggtgcacccacatcgatcccagccagaagaacgagaacgcgtaggccagaaactgcggccacaacttcccgaatcccgaccacgtcagcggatccggtttatccaaatccaacacgagaatcgtcatgatgatggccagcaccgcatcggtgaacgccaccactcgttccttgctcatcgcacactcccagaccctgcgactgcctatcatctctccatcttagcctatcctcccgcagcccgctcctgactattctcactgcttatttccacgcagatttccacacctgcgcacacggtgtggaaaaccgacaaaccatgccgaatgtcgtgaccatcggtagggacgattcggtagaatagtgagattatggctgccagcacgcgagaaaacagagctcccgcttccggcatgccaaccaaacttgaataccgcacgaaacacgaggtaatgatggcttctctggtgcaagaaccttcgtcgatctctcagaccctcaacaccgaaccacgcccgctgcgcataggtctggacatcggctcgaccacggtcaaggcggtcgtgctagacgattccgactccctcgatgccaccctgttcgcagattaccgtcgtcatcatgcgaacgtgcgcgcgacgatggagggattgttgcgtgacatccgtgcccatctcgccgaactgggtcgcgcagatgagcccgtgcgcctggccatcaccggttcgggcggtttggcgctcgccgatgccgtgcatgtgccgttcgtgcaggaggtgatcgcggagacgcgcgcaatcgacgaggcgatcccgcaggcggatgtgatcatcgaactcggtggcgaggacgcgaagatcacgtacctgaagccgacccccgaacagcgcatgaacggctcgtgtgcgggtggcaccggcgcgttcatcgaccagatgtcgacgctgctcgacaccgatgccgccggtctcaacgagatggcgaagtattaccagacgctgtacccaatcgcatcgcgctgtggtgtgttcgcaaagacggacctgcagccgctcatcaacgacggtgctgccaagcccgatcttgccgcgtcgatcttcaccgccgtggccacgcagacgattgccggcctggcttcgggccgtcccattcacggcaccgttgtgttcctgggaggcccgctgttcttcatgagcgagctgcgggaggcgttccgccgtgcactcgatggcaaggtggacgagttcatcaccccgaccgacgcgcacctgtatgtcgcctacggtgcggcgctcgccgttggcgagcccggccagatcgaacatgccgacgagtacccggcacggtcgctcgacgacattatcaatgcattggaggatctgaagaacctgccgtcgaacacggccacgatgccgccgctgttcgacaccgcggccgaccgtgacgcgttcaatgcgcgtcatcaccgtgagcatgtgcatgtgggcacgctcgagggagcccgtggcccgcacttcctgggcatcgacgccggttccacgacgatcaaggcgaccttggtcaacgatgaccgcgagatcgtgtggtcgtcgtatgcgacgaacgatggcagcccgttgactgcggcgatcgagatcgtcaaacgcatccagtccgaattgccgagcgatgcctggatcgcacgttcctgcgctaccggctacggcgagggtctgatcacgaccggtctccatctcgacgagggtgtggttgagacgatggcccactaccgtggtgccgaaatggtgagcccgggcgtcaccgccgtcatcgacatcggcggccaggacatgaagtatctggcggtcaccgacggcgtgattgactcgatcgccgtcaacgaggcctgctcgtccggctgtgggtcgttcctgcagaccttcgcgcggtcgatgggattgacgatcgaggagttcactcaggcggcgctcgcctccgaacatcccgtggacctggggtcgcggtgcaccgtgttcatgaactcgagcgtcaagcaggcccagaaggaaggcgcgagtatcgaagacatcgccgccggcctgtgctattccgtcgtgcgcaacgcactgtacaaggtcatcaaactgcgcgattcgggcgagctcggcagcacggtcgtggtgcagggcggcacgttcctcaacgacgctgtgctgcgcgcgttcgaactgctcaccgaacgcgaggtgacgcgccccaacatcgccggactcatgggcgcctacggcgccgcgctcaccgcgcgcatgcactacgacgacatcgccgacgacacggacggcgacaccgacgccgccggcgtgcacgtggcgtgcatcgacggcgtggaccacaccgtctcgagcatcctgcacggcaccgccctcgacgagctgtcgatgacgaccgaacgcgacgtgtgcaaactgtgccagaaccactgcaagctcaccatcaccacattccacgacggatcgcgctatgtgaccggcaaccggtgcgaacgcggcggcgacgccaaacgcaaacgcagcgaccggcccaacctgtacgatttcaaatacaagcgtgccttcgcctaccgccgtctgaccgacaaaaaagccacgcgcggcgaaatcggcataccccgcgtactcaacatgtacgagaactacccgttctggttcaccctgctcacgagcctcggattcaaagtcgtcatctccggacgctccaaccacgaactgttcgaaaccggcatcgaatccatcgcctccgagaacatctgctatccggcgaaactcgtgcacgggcacatcaagtggctcctcaacaaaggcatccgcacgatcttctacccatgcgtctcgttcgaagacgacctggtgccagaatccgacaaccactacaactgcccggtcgtggcgaactacccggtggtcattgaagccaacatgcccgaactgcgcgcagacggcatacggttcatgcgcccctacttcaacctctccaagcacagcctcatggtcgaccgcatcgtcgaggaattcgcatgggccggcgtgacgcgcgaggaggccgaagcagccgtcgccgccgcctacgccgaagacaccgtgttcaaacacgacgtgcagcaggaaggcgtgcgcgcgctcgcctacatgaaggagcacaactgtcgcggcatcgtgctcgccgggcgcccctatcatgtcgacccggaggtcaaccacggcatccccgagacgatctgctcgctcggcatggtcgtgctctccgaagactccgtcagctggctcgaccccaacgacgtgcccgcgctcaccgcatatctcgccgaagacgaaaccgacccggccgcccacacgagcgaagggttccggcacgtcaacgaccgcaagctcaccaccatgccactgcgcgtgatgaaccaatgggcctatcacgcgcgcctctaccgcgccgcgcagttcgtggcctcctggcccggactcgaactcgtgcaactcaactcgttcggctgcggccttgacgccgtgacgaccgaccaggtgtccgagatcctcgccgacaaagcggacgtctacacgatgctcaaaatcgacgaagtctccaacctcggcgccgccaaaatccgcctgcgctcactcaaagccgccgtcgaggaacgcgaacgcaacgcccagcgcgccgctacgcccgcagctagcgccggcaccttccggcacaccggcaccgcagcgcccacacccggccggcaaatcctgctcgatgccgtcatggggaggcaagccggcggcgcccagcagaaccggcaaagcgccaccatgagcgcctacgccaaccgcgtgcccttcggcaaggacatgcgccgcgactacaccatcgtggccccgcagatgagccccatccacttccggctcgtcgaagcggccatacgcgcctccggatacaaattcgacgtgctcgaacacgccagcaaaaccgacgtggaaaccggcctcaaatatgtgaacaacgacgcctgctacccggcgatcatgaccgtgggccagctcgtggaagccatcaaatcaaggcggtatgatcccgacagcaccgcgctcgcgatttcgcagaccggcggcatgtgccgcgccacgaactacttcgcgctgattcgcaaagcgctcgtcgacgccggctacccgcagatcccggtgatcgcaatctccacgcagggattcgtggacaatcccgggttcacccccaccgtcccgctgctgcaccgtgcggcgaaatcactcatcatcggcgacttgctcatgaagtgcctgtaccgcgtgcgcccgtatgaggcgaatccgggttccgcgaaccgcctgtacgagcggtggaacgtgatcgtgcgcgagacactgctcaaccacggcatgtcgaagaccgcgaagatgctgtacgggcgcgcgtactggccgtacgcgaaactcgtggcgaagatcgtggagagcttcgacgcgctgccgctgcgggacgtcgaacgcaaggtgcgcgtcggcgtggtgggcgagatcctggtgaaataccagcccgatgccaacaaccacgttgtcgaagtgatcgagtcacaggactgcgaggccgtggtgcccggcatcatcgacttcatgacgatgcgcccgtacatcaacgactggaatgagcacaatctgggcacggggcgcaacaaagcgttgtacacggcgttcaaaggtgtgatccacacttacatgaaacctgtgaacgatgcgcttgaatcgagcggcggcaaattcgagaaagacctgccgatggaccagctcgtggccaaggcgcagaccgtcacctcgatcggcgtgcaagccggcgaaggctggctgctcacgggcgagatcgtggagctcatcgaatcgggctgccccaacatcatctgtgcacagccgttcgcatgcctgccgaaccatgtcacgggccgtggcatgttcggcaagatccgccggctctacccgcaggcgaacatcgtctcgatcgactacgaccccggcgcgagtgaggcgaaccagctcaatcgcatcaaactgatgatcgccgcggcgaagaagaacgccgcagccggacgcagcagtgtgtgaattgcgcacgttatagggattttttagaacaagcgcgccgtgtccatatgcgcgcgcgttagtatgggcacttatgacagcaccacgagtttcctacgcgcacctgctggttcagccgaacccgcggcacgtgcgcagccttgtccgcttcttcgaggaggggtgctccgcgccggggaccggggggttcggcgtggagatcgaacatctgcccgtgcacaacgccgacgacacggcggtcacgtacggtgagccgaacggcgtggaagaactgctgcgccgtctgcgcccgtactacgactccgcgcaggagtactggcaggacgatcatctcgtcgggctcgcgcgtgagggaatcgccatctcgctcgaaccgggcgggcagatcgagacgtcgatcggcattttgcgcaaacccaaggatctgctcgaactgcacgggcagttcatgcgcgaagccacgccgatcctcgacgaactcgattttcgcttggtgaactacggctatcagccgaagagctcgtacgcggacattccactcaaccccaaactgcgttacgccgcgatgaacgagtacttggggcgcatcgggcagttcggaccgtgcatgatgcgcgcatccgcctccacgcaggtgagcatcgactatacgagcgagcgcgacgcaatcgacaagatgcgcctcggcaccgcgatcggcccgatcctcgcatggttcttccgcaatacgccgtatttcgaaggtgcgccgaacccgtggccgttgtgccgccagcgcatgtgggattacctcgacgtgcagcgcaccaacgtgacgccgggcctgtacgacgagcggttcagctgggaggattacgcagccgacgtgctgagcaccccgctcatgttcgccgacctgacccacacgccggaagcggaaggcgcgtctgtgcacggcactgagttcacggcgttctacacgacggccgccgacctgtacccggaccgcgagctcaacgcgtacgagatcaaccatgtgctctccacgcacttcaacgatgtgcgcctgaagaacttcatcgagatgcggcactgggactcactgccaatcgagcgcgcggaactgctcacgcagatcgtgagcaacctgttctacgatgtggagcgccgaaccagcctcgaatcgtacttcagcggactgaccggcgaagacgtgcacgccgcaaaggccgtgctgcaggcgcgcgggggagacgcgaagccctacgaccagccgatggactactgggccgaggtgctgggtgtgggcgatgcgctcgcagacgtgccgggcgacgcgaagtggccggaggtgcggcaggggtaggagctatcccgtgcgagggctgcatcatgcagcataaagcggggaatctctcgcatcaatactttgtaaggatttgttgagtttgtgtagataaatcagtcgtttgtatcacgtcaatttgtctacctctcgcaaaagcgcttatcagactatgtgtatcagtctgtattatggctactatctccgaagtctcggcttcggagcttcattgaggggacgatatggcgctcagcgtggcggagtgggaggcggatctccgaagtctcggcttcggagcttcattgagggaagaccggcaccgaacgcgacttcaccatgacctcatctccgaagtctcggcttcggagcttcattgaggggcccaccacaacggcaacggcggaggaacacgcgccgaaatctccgaagtctcggcttcggagcttcattgagggaagccgaactcaatcacacgcatcaaagcgaacaatctccgaagtctcggcttcggagcttcattgaggggtattcgccgttcgagaggaatgagaggatgctgtcagatctccgaagtctcggcttcggagcttcattgagggtcgccattggagacgcgacgcaggatactatccgatctccgaagtctcggcttcggagcttcattgagggacgacaagccgccgccaccgatattcacctgcgaatctccgaagtctcggcttcggagcttcattgagggggccgcttcggtgacgggctggtttttccaccacacgcatctccgaagtctcggcttcggagcttcattgagggaatcccagccgcaaggtctgatgccgcctgaaatatctccgaagtctcggcttcggagcttcattgagggcactggtggtgcgaatacgccgaaacggtggaatggatctccgaagtctcggcttcggagcttcattgagggattgagattgatacccgtggcgccgctgatgagacatctccgaagtctcggcttcggagcttcattgagggaatccctcggcccatgattcgtcacgtgggatcacatctccgaagtctcggcttcggagcttcattgagggaaacaggtcaatcagcggcgcagggaggagacgaaatctccgaagtctcggcttcggagcttcattgaggggagtgaacaactcactgtgcgaaccatcgaaccgttatctccgaagtctcggcttcggagcttcattgagggcggttgagcagccacgtggtgatactgctcgcgccaatctccgaagtctcggcttcggagcttcattgagggcttgcatccaacgcgcacagcattgcatacgggtatagatctccgaagtctcggcttcggagcttcattgagggatcatcctcacggaaatagtgagcatcctcgagaacctgatctccgaagtctcggcttcggagcttcattgagggggccgcgatagtccacgaggcgaacgaaggcgttgcatctccgaagtctcggcttcggagcttcattgaggggctcaagacactcaccgaccagctcaagaagaccgaatctccgaagtctcggcttcggagcttcattgagggcgcgatcgtcaccgactgcactgtgttcgcactgtcatctccgaagtctcggcttcggagcttcattgaggggcgacaccgaacgccgccgccacagtcgggatggcatctccgaagtctcggcttcggagcttcattgaggaagggccagcaacgtcgtggagatccatcaggaggcatctccgaagttttggcttcggagcttcattgaggaatgtactccgatttttatctaagcaaaaatgaagtatgctgagaataacgcaatgaagcgaggtgaagggttggaagatacattaccgattagtctcatatgtgactttatcttttgtccacgaagggcatggttagaaatccaaggtgagaagattgagtcgttacagatggagcgcggttttcatgaccatcgtgcagtggatgacgccaacggtggccgcggggatactgactatagggcagttaatgtgaatcatcaggggtggggactgtcggggcgattagatgcggtccggttgaatgaagacaacggtgtgattatccgtgaatataaagctacacccgtgcgtaggagtatggatgtgacacatgccatgcgtatacagctcgccttgcaggctgcatgcatggaggatatgggttatcgagtagatgggactgaaatattctttacctcgcaccatcggattgttcctgttgaactaagaaaatccgattacgaggaggcttacggttccgtgcaggaggttcgtaagcttattgagtgtgaaacagctccattgccttttgaggatgatccgcggtgcatgcgttgctcgcatgcaggtatctgtctacctgaagaacgcgcgcataacattccggaacatcgtattatggtgaaagtgccggatcatgcggttactcatctagcgacgcctggcgcacgtgcctacttgaagtcaggacgtatgcatgtctccaaaaatggtgatgaaatcacctcggttcccctggattcgattcaggctctccagatacacgggaatgtagatgtatcaagtggtttgatgagagagctgatgtggcgtaatatccctattctctggtgcagtggaacaggtcgactgatgggttggtcggtttcttcctatgggcccaatggagagactcgtgtcgctcaacatgtcgcttcgcacgaagggcgactggatcttgctcgtgagttcatatcggcaaaaattcacaatcaaatagtattgctccgacggtccgataaaaacaacaatgttttgtttgatatgaaacatatagagaaatcagtggtgaatgccaatcgtatacaggatattctaagtttggaggggcaagctgctgcgttgtacttttcgcaatttcatcatcttatcagcgtgaataagcgaaatgagtggccatggttggaacgaatgcgacaccctgcgcctgaccctcttaacgcattactggattacacctactctcttttgttgagcgactgtattcgcgcgattgtatcttgtggacttgatgcacatgcaggttttctgcacagtagtaaacgtaataagccggctcttgccctcgatcttatggaggaatttcgtgcgcccattgcggattccgttgtgcagacggttgtgaacaatggggaaatcaagcgaaatggattcgctaatgtgatgggctctgtgcggttacgtgatgagactcgtaagaccctgatcggtgcgtatgaacgacggatggcaacggaattgaagcatccggtttatgcatatcgggcatcatggcgcaggattgtggagatacaggcacgcatggtgctggggcgattggagggcagccttgagcgttatcggggaatacgagtgcgttaaggggtgattacatgaataatttgatgcagcggtacatcattgcttatgacatcaaggatgattctcgaaggattcgtgtctccaagctgctgcagagttatgggaacaggttgcagtacagcgtttttctcatggaaatgcgggaggtaagacttgtgaggatggaagagcgacttcatacgttaatcaatggtgcggaagattcggtggttatagctcggctggatgatgcgaagacttctgagtcgattgtttttataggatcgcgaaactatgaagatgtgagagtgccgacagtgatttgagtgctggtttggtgtgaaaaacgattagggaaaacgagaatgtcgggatcttgagttgtatcggtgtacatatgtatgtagctgatggatttgccggattcgtgagtttttacacaatcgcctatgtcgatgtgtgtcaggatgtatgatggtgttttctccgaagtgttattgcggatattgcagtaatggttttcgtgggcagcggtgtgctgctgttcagcgtggcaaatctccggagcttcattgagggatgttgtagtgatcgacctctcgtttgattccatctatctctggggctattgtggccccggagcttctttgtatgcatgctgatttggtgctgcttaacgatgatggtacgatgtgtgagtagtgaatcgatctcactaaaacatgtagagaaaagagcaatgatgcgcaaactcacagtacaagacttgaatgaagcggcaaaaattgggggctcgaatgcgctgacggaagtaacgtcgctcgcaccggcagcaggtatgggtagtatcgtagctcctgcaaaatacactgctggtaatgggtcgacgtatgtgtacgagaagcgctgggtgaatgatgagtgtgttgatactgtgctcattgattctagaacatcacaggccaatcgtttggaagactacatcagccgagcgattgaagttggccatccgattttcagtaagatgccccaagttcgcgtacgttatgagatgatcccaggagacgaaagcagcgtcaggtatttcgatgatgttcaattgccacatcgtgcggtggacgcgcatattcgcatcgctgaattcagtgaatccgacaaagtcaagtacatggcggcacgaaactcctccttggaggatttgtctgcaatgctggcgatttccccagtgacagtgatgtttgggtgctgggactcaacacgaaacaagaaccaactgcgtattcccgccagcttcaacggtgagatttatgcggtgcttgctgatcagacgcatgagtctccaattcatcgtgcaggcgcgcgtattgatccagttgcagccggagtgcatctaaccaaaaatgaagccaagaaaattgctgagcgcatcaaaggaacaatgaatgacaagaagctcagcaaattcgcgagtagcggggatggctcaactatcgtcattggtgcgattcccccatcaactgatgcaaatgctcttgatggcatcgcagttcgtagtattacgcgcacacatgtcctgagtttctccatgcttcgggctatgcgcttcggtaaagggccagagggtgatgaagctatccgtgtactgctggctgcagcgttgatcaatgcgatggttggaagcaatgcggaattgcatctacgggaaaactgcttccttgtggaagctgatgagccgaaaaccgttctggatcgtcgtggcggtaaacatgatgatttggagatgcttacgctggaagacgccgatgagctgttggctcaggcatatgcacaagctcagaaaaaggcaggcattgattggcatgggcaaattatcactgtgcaaggcgaccctgcagtgattgaatctgcaagcgctgctgacgacgatgatagatgataaccggaagatggcgctatgacgttcgcgattcgtatccacttccttcttgcttcctatcaaggagcaagcgaatatggggagaaggaatcttttccaactcccatgcgtttatatcaggcaatggtatcagccgcacataccgttttttcatctgaaaattcacagggtatgcttgacaagcgtttgaacgcagcactcgaatggttggaatcgaatccgccggaagcgattcgttttccggagatagtttcgcaatctccaacctcccataatgccattgcttataggcgtaaagcagacaaagctcccaaagcggagcgggcccggtcggctgtgatgtaccgtactgatgaacaaggggatatgatcctcgagtggaaaaatggcccagacgacgaagagtgcagtacaattgcagatttgtgttgggagattccattcttgggtggcgctggaagtcctgtacgtattactgtcgaggagggatttgatttcccccttcctgattcgtatatgctgcgtccggaatcacaatcattgatggaagtcgagcgtgcgcgcgaattgccttgccctgcgccggggcttcatcaggagctgatggagcattacactcaggctaatccacatccagcctctaagattccgaaggattcatccacaaaaaaagacacagaagtcagatctgagaaaagattgcagtgtgtacatcgcagtacctacagccctcagaaacaagccaagtcggcagtacagctgccatggactcgtatgattatcattcccgcgcgcgtggagtcgaatgcttcggcgtggaatcctcgggatgatgaattgactgcatggtgtgtggcgttgcaccgcttattagtgcgacgttggggtacggatgttagtccatatctgaccggtcggtggtccaccgattctatggttaaacgtccggcgaataacatcgccattcaagttctgcggaaagattatgcgtcgttgattgcagaccagagaatcgcagagtctcttcctgccttcattttgatgattcccagcgaaatggatgctggggaattgcggaaattgggtacgctagtacgttcgttggccaactccagaatatactattcacacagcaagcctgcactccgattagggaatccaatccctggagaaggggtgcatctgtggagtaaaccaagggatggcatgcatcgaatatggtcacctatgccattttcggtcaatgaaacacaagctgaaaaaagccccgccggacaaagcaggtcgtggaccgcggaatgcaatcttgcggtttccatagggcacgtatttcggaacgtgttccgtgggcaaattgccgaaaaaagaggcaggggtaagtactgggatctcattgatgcagtgactgcaggagattcttttgtacgtattcttgcagcgcgtaccgtggctcgcccagatatgggggattatgtgcacagaatgcgtgagggcttcatgattacggcatcgaccggattgattgcatttgagaatgtgattaaagatgagattctcgctatcgggcagagcaggcactttggcgggggcttactcattcctatggattgtcccgaaagctgtttcacaacgaaagggcaaccgaaatggagatgaatgcaacaaccccaaacgagatgctcgtagaactgtatgatcttttcgtggaatcgttgcatcaggggcgtaagccatatttatggcagacgcgtttgatgcgtgaagtcgtcaataacggacagtggatgaaactgatatccgcaccgaccggttctgggaagactgccgtcatcgacgtgcacctctttgtcaatgcattggcagggctcgctgcattggatgatattccgttgccgaaagaactgaatcatctgctgaaaagcctttcattggatgccgttccacgacgtatggcagtgacggtcaatcgacgtggcatcgtggatgatcagtatttggaagcctcggctgcatgcgctcgcatcaacgatgttgcgtcattagacgatgacacggaatctgagattcttaagctcattgcagtcggtctgtatgcgaggcagtattcggaactaatggatcgacagtggacgtttgaccagctagctttccagtgtcaggaacagggtaaggtcgtctgctctgcacaacgcttgcgcggaggccttgatgataaggctgatatgcgcgtttggcggtataaaccgctcgaatgccagatactgtgtggtactcctgacatgattggcagtcgactgctattcagcggatatggtgtcagcgatgcggcaaaacctatagaggctgcattgcttgcctatgatgcagtcatcgtagtggatgaagcgcaactgagtagacaattcgcatacaccgctcaacagattccaagaattgaagcctgtattcgccaaggtgagccattgccggtctctcctctccaagttgttgtgacaacagccaccccttcaggggagaatatatccaatctgcaagatgaacagagcatctgcggtgtggaggaagctgatttcaaaatcgatttagagctacgcaggagattgcggacgccgcgccctatacaagttctttcagttgatgacaagcagatcgccacctgcatggctaaggaaagcattgcattgcaggagcgccttggtggggtggtcgtatgtttcgtcaacacggttccgcgtgccagcgaagtagttaggaggctcagggaagcattggggaaggatgccggtgacaatgcagttcgtgcattcgttggccctatgcgtgattatgagcgagatcaattcgtgcaacgattggattccacggaacctctctatgatgcaattcgaggtgaccaatctgcgattacgcagacaggtctgaagttcgttgttgctactcagacacttgaggcaggtattgacgctgacttcagtggaatgattagtgagttggctccggccgcatctctcgttcaacgtgccggtcgagtgaatcgacgaggattgcgaccagaaggtccagtcgtcatatgctgtcagaacagtggaaagattcgtggcccctatatgaaggaagacctaacagctgctcagatgtggctggaatcgctacctgtggagggactaacggcatggtcatctgtccttcaaccgcctgctcctgcgcaattagaacgtatggtacttcagcggttggaatggtgggatgttgagaatctgtcccataccagcgaagatgtatttgctgagcatagagcggcagggcgcccgtatcctgcggatgttgacttgtggttaagggatgacttagctgatcgagtcacgccagatgttgcggtagttatccgtactcttccgcaggatgattatcttgcacagcgtctgttggcaaccacacctccggattcgcgtgaattattcccggtaacatcatatgcaatgctggatgctctgcaaaacaaattaaaagggcgccgagcattcatcatgcgcacgaattcaagcgagaacggtaatgctgtacatcttttagatgggcaggcagattcagatccaaccttgcgctcgggagatgtgctcattgtcgatgacggagccagagtgttttctgaggggattcccatgctcgatccctttagcaaggacgataaacattcaaaaaagcttcaggacgaaataacgtcgccgggggatgtattcaacaaatgccagcaatcgatggctgtccttcatgcgaatagagagaaacaacctgcactatatgaggaactgtctgaggtgcttcgcgcagaaactgatactgatgagactgttgaagccgagtatcaggggattgatgtctcgaagtatccaaatctgcaagaggcgttgaattcctgtgcgattaataatcacggttttagaatcgcattcgtagatggattcatcgacggtgattcaagtgattcttcagtattcatagtgctgcagtcctcggatgcagcagatggagaccagttgcaggaaattgggcgttttaatcgccaaggtcctgtgctgcttgatggtccgggaagccatcaggaatccgtagggtcacgcgcagagctattcgccgcaaagctgggctttgattcccgacttgttgctgatatacgaactgccggattacaccatgatgacgggaagaaagatccgcgtttccaaacattgctacgatatcgcatgcccaatgtgccagccgagccattggccaaaagtatgtatcgttcctcatcctgggaacgtgccaagcgcatcgagttgaggctcgacggatggcggcatgaacaacgttcagccgctgaatgctgggctcttgactcagaatctttgcaggctcatgacaaggaattggtgactagacttgcggggacatctcatggtcatggacgttccatgtttccgatgaatgctcaacaggtcataccagatgcaatcatccagactgtttccgaagagaatggcgatggctcccagaccatacatgccatccgctccgcagcagaagagttatttgatgcagggtactggcagagcatcatggaacgaacgaatgagcgttacggattgtggggcatcgcttttctggaaactttgcttcgtgccgctgatgtgacgatatccatggaaggacgatgattaatgagcgttctgcgaattcctgccgattacgatgatgcgttttcacacatgcttggttttgggttggcgtccatacttgaagatgccgtggaagaccgcatttgtagattgtggtggagcggacggcacaccctgatggtggagacaaatgacgaaataaccgagatggaatgcgctcatatcgtgcgtgcccatgccgaacgctggcataagtcgcagtggcttaatgcacgtggctcttatgcaggtaaagggaaaactgtagctacgctcagccctcgcatcggtacggtagccggtcgcgaggaatgggtagcgctcgaacgagatcgacgtgatgctattgattcattgcggacgactttggatgaacgttatatcggagcgttgggagaaccatcatattggtctttgaatcgaaccaaagctacgcctgaaattcagcagaaattcggagccagcctatgggagatgactccgcgcaacaggggaaatgagtttgtgacgatgcgattgctcaaactcgcctcgattataactgcacgtaccgcagagaaagtgcactcgggactttttggattgacgaatgttgacgaacttgcaggcacggaagatagccatacgcccactgggctaaaggtaccttctaggactgataatgctcgtgcttggtgtgcattgttcggtttctcgaattgccccgtgtatcgatcagtgcactacgagacaagtccgacggctggtttcatccgtcatgattccggtggcggtcccagctggcatgtcgtccttccattgacagaaaaatcttggacgcttgcgaagtatcgttcagtcatacgttcctatgcgttggattatgtaggtgagaatgctctccatcttgatcaggactctttgtccgattcaacggtagccctgtatgcggaattgtgccgatggctccgagatcaaggtctgcgatattgcatgttgttccagcggcatggcacacaggcgaagagccctgagtactggttactgcgcgggcagctcatacggctctagcatcgaagatgaatcacgaaaagttgcgtactatcatattcgcggaggatgcgctgacatgcacacgacgttagatttgagccaatacaatgatgtgacggcatatgctgatgcagtacatcgtccagtggtgcatgtggattatctgccaactccgcaagctgtcgcacgccgtgtgcgtgaggcggtggatgaccggcacctgagtatggagcagctggcgaaggatgcgcatgtcagcattcaggctgcgtactcgctgcgcgatagtggtttggcgagtctgagcgaggctcgacgtgtgttcgctgtactggatattcatgtgcatgcatacccggtggaaatggtgccattgtcgctatgagtgatgtgctgcatacttggatggacgattgacatcatgtgggtgtaatcactcttggcgggaaaggcgtggccgattttgagtatgatctgatctccctggccagtcatatacgtcctgggataggaacctgtggatggaacgcaactgcgctactgtgccatctgggacaggaagatcatccatcagctccagtgcctcgccgtgacaagcgaatgctcgatctccgccaattcccgttgcgtgtgcgcaccggaaagattgcgcaataaatccgtaccaggaacaagatacggatcgaacaccggttcgctcatcggtatgtattatctgtcgttcagaccgtaccgggcacatacgcgaaggcccaatgtcgcggcgtcaatcagcccattcgcgtaatcatgcgcttcatgcaggagcacatccgatacatggccgccctccatctcagcggaatggagggcaagggcaagattgcgcgtattgcgcgcggccttcgcggcacgcaccatttcaacatcggattccttcacagacatgactcaattatcccacatacctcctgtcatcgtaatgcttttatcatggttgatcaatgaccatcatgtctatcactgaacgcagccgagcatactgtgggagatggaatgcgccgctacgcgtcacatgctgttttgtcccgcatgtgcggggatgatgtgtgatctttccgttgcttcagtactcatgatttcattttaggagccgcagagtcgctatgtgttttggcatggcggacgctagcgggcctgcctgcataaggatgattcgaaaaccatatgattaacggttgcgctcttttgctggtttaggtcccattgattgaggtagagtcgtattgagcggtttcctccgaacccgttattggctcttgggaaccgcttccttcgctgcttttcgcgtaatgccataattggctggtccgggtcaaaatgcacctaccactcttatcgtctgttaccgccttctgggatggcagcagtttctgtttttgctacgggtagtgttctttctgctacgggtagtgcttttctggcgcactcgtcactatgatccgccatatttcaacgattgtaggtggaggttacgcgaggaatcactacccgtagcgggaggagcactacccgtagcgaagaaggtactacccgtagcggtggcaggaccacggccatgtcgaattcgctgtttatgtcacccgcacggctgttggtgtcgatggtcagacatcgacagccatgcgggacgcgattattggactcccgtgactgacctcagccatcaactaccatctccggcgactcctacgggttttcatgggtgagctcagacgccaacagccatcactgaacttcgtgacggggcagattgcgcgacaacgctctagagagggcaatcgagtaaccgaacatacatattggcgcatagcctcaagcgtggaagtgacactgcagcaatccgcgcctgccgcctagatgttagcacctgcgcgcagcccccacaaatctacaccccttccgcaatctgccccacaagtcgctcgagccgcgcttcgcgtgcgtcgccgcgcagctcgcattcccacacgtcgatcacgcgccatcccatctgccgcagctgctcgtgctgccggcggtcgcggtctcggttgcgcgtgagcttcgccgcccagaactccacattcgacttcggcatatggaacgactcgcacccctcgtgcatgtgccagaaacagccgttcacaaacacgattgtgcggtacttgggcagcacgatgtcggggtgcccggggtaccgcttgtcgtttttgcggaatctgaacccgcgcgcgaacagataggagcgcaccgtcttctcgatcgacgtgtctttgccgcggatgcgcgacatggtgtagctgcgcgtgccgcgcgcgtacggggactctgggtgcgagggggattgtgccacgccaccagtatcgcccgggcagtggatcgtccgcgcataccattgcgcgcccttccgcgctttgttcacttgtggctatttccgggtgcgccgcacacgtcgacgcaccatgatggataccagttcacagctccgggccatgcatgaccaccatgccgccggccggggcataaggaggagacatggcagacaagccgactattgcgtttgttgagacttcgctcaccgacggttcgttcgaggcggacctcgcgaaggagatcatgggcattgtgggcgaccgcgccgaagcgatcaccattgattacgaggatctgccgctcgccggcgaagacccggagtatccgcttccggaagccgcgctcgccgtacgcgacaagctgggcaatgcggacgccgtgtgggtcgtcgtctccgagtacaagaaggagattccggattcgctgcgcaacctgttcgactggctgtcgctgccgtccacgaaggatgaagaaggcaagaacgtcctcgaccagaagccggtcgcgatttccggtgtcggcggtttcgaggagctgcatccgcgcatcatggtcggcgatctgttggaggacgccggcatgcgcctcttcccggtcgaggtcggtctgtccgtgccggacgaggccgtcgagaccggcgactgggcgatgactggtgccgatcaagaggcgctgcgcacgcaggccgatgacttcctgaccttcgtttccgaaaacgaagtcaagtgaatccactgatgtgacgggtcggcagtagtcactggcccatcatgtgcgcgatccgcgacctgcgtgctgtagggcgcggatcgcttgcatatgtggaggcggtgacgcgcgattgttgcacgggttcactgtcggcatagtctagttgtatctgcaactgttgtatacggaacaatctatagtgttctgttgcagtagcgacgttgtggcatcgcaatattcccgcgtcgaaatatcacggcaagaggagagcgcgcatggaccgggtgcaaggtgtgaattcgccgggcatgctgcgcccgagcctcgaaatcaaggcgctccacaatctcatcggccggtattggaacggcattgtgcccccggactccatgatgtcgggcgccaacatgcccatcgtgcagtatctgcacgaacaccgcgattcggatgtgttccaatacgacatcgaacgggcgttctccatcactcgctccaccgcgtcgcgagtgctcggactcatggaaaagaaggggctgatcacgcgttccgccgtcgattgggatgcgcgcgtgcgcaagatcgagctcacgcccaccgcgtccgaccttgttgtggagatcatgcgcgccgcgcaccagttggagacgacgctgttcactggattcaccccggacgagcaggaacggttcatggacgaccttgcccgcatgcgtgccaatttggtggagaccgggcttgtcggctccgagcgcacggcggttgagccggccacacgtaccaggcaagacgccacacaccagcagcagaaaggagatgaggcagcatgagcactaccacggcaactgacaccacgccatccaaggcgcatgtcatcaggacattggcgaagtcccttcgggaataccgcacggcgagcctgctttcgccgctattcgtcattgttgaggcggtcatagagatcgccatccccaccgtcatcgcgattcttatcgataagggcatcagcggcaaatccatgccggacatctggaagtacggcggcatcctgatcgcctgcgcggtcgtgtcgttgtgcgcgggcttcctgtccggtcggttcgcggccatcggttcctccggttttgccaagaacctgcgccatgacgagttcgagaaggtgcagcagttcagcttcgcgaacatcgaccgtttttcgacgggctcgatcatcaccaggctcacgaccgacgtgacgaacgtgcagaacgcgtaccagatgctcatccgcgtcggcatgcgcgcgccgatcatgctcatcgtcgcatggatcttcgcgttccgcatcagcccgcagatctccatggtgttcctcgcgtgcatccctgtgctcgcggtcggcctgttcggcctgatcatcgtcgtgcacccgatcttcgaacgcgtcttccacacgtacgatgagctcaacaacgtcgtcgacgagaacctgcagggcgtgcgcgtcgtcaagtccttcaatcgtgaggatttcgaaggcaagaagttcggccgcatctcgctcaagatctacgagcagttctgcaaggcggagaagctgttgtcgatcaactcgccgctgttcaacctgtgcatgtacgcgtcgctcatcgcgatcgcatgggtcggcgcgcgccagatcgtcgcgtccggcaacaacgccgcgctcggcttgacgacgggcgacctgaccgcgctcgtgacgtacgcgatgcagatcatgatggcgatgatgatgctctcgatgattttcgtcatggtcatcatctcgcgcgcatccgcggaacgtatctgtggcgtgctcaccgaggagagcacgatccgcgaggcggacgagcccatcacgaccgtggccgacggctcgatcgacttcgaccatgtgtcgttccgctattccgaacactctgaacgcccggtgctcgatgacatcgacctgcacatccgttcggggcagacgatcggcatcgtcggcggcaccggttccgcgaagacgtcgcttgtgcagctcatcccgcgcctgtacgatgtctcctccggcgcgctcaaagtgggcggcgtcgacgtgcgtgactacgaactcgaagcgttgcgcgatgaggtcgcgatggtgttgcagaagaacgtgctgttcgcgggcacgatcgcggaaaatctgcgctggggcaatccgtacgcgaccgacgaggagattcgccatgcatgcgaactcgcgcaggccgacggattcatccaggaattccccgacaagtacaacacgtacatcgagcagggcggcacgaatgtctccggcggccagcggcagcgcctgtgcatcgcgcgcgcactgctcaagaagccgaagatcctgatcctcgacgattcgacgtcagcggtggacaccaagacggacaagctcatccgcgaagcgttccaccacgagatcccgaacaccacgaagatcatcatcgcgcagcgcgtcgcgtccgtcgaggaatccgacaagatcgtcgtcatgcacgaaggccgcatcctcgaccagggcacgaacgcggaattgctcgagcgttgcgaggaataccgcagcatctacgaatcgcagacgcagcagcacagccaacaggacctcgacaaggaatcgcaggacctgcacgaggaagaggccgaggcgagcggtttcgcgaccgactacaacgaagacatgcgcacaagcgacgtcatcgcgcggcagaaggagcgcgaacgcgagcagcaagcgcatatggcgcaagacatcgaagcaatcaagggaggtgaacaacgatgagcgcagcggcggcaacggtggcacagacttctgccaccgacaaagagaccctcaatgacgacgcgcgcatgcccgaggcgaacggcgcgcaaggcatgccgcgtgagaaggcgaagaagggcaccctcaagcgactgctcaaatacgtgttcacatacaaggtgcgcatggtggtcatcatcatcgcgatcatcgtgtccgcagtcgcgcaggcggggtcggcattgttcctgcaggcgttgatcgaccggtatatcatgccgcttgtaggggagagcgtcccggactgggcgccgctcatccaagcgctcatcttcatgggcatcctctacgcgctcggcacattcagcgcgtggctgtactcgtatctgctcgtcggcgtcgaacagggcgtcatgaaggagattcgagacgagatgttcgaacacatgcagacactgccgatctcgtacttcgacacgcatgagcatggcgacgtgatgagccggtacacgaacgacaccgacacgctacgccaggcgatcagccagtcgctgccgcagatgttcgcatccggtgtgtccgcgcttgcggcgctcatcgcgatgctctacctgtcgattccctacacggtcttcgtccttgtgttcaccggtctgctcctgctgctcatccgcgtgattgtgagccgttcgggccgctacttcgtggtgcagcagcaggagctcggcgacgtgaacgccttcgtcgaggagtcggtcaacgggcagaaggtcatcaaggtcttcaaccacgaggacgccacacaggcgtcgttcgacgaccgcaacgagcgcctgtaccacgccagcgcgagcgcgaacacctacggcaacgtgctgatgccggtcgtcggcaacatgggctatctgctctatgtgctctccgcgatcttcggcggcctcgccgcgcttggcaattggggcaacctgagcttctccggagccgcgttcacgattggcacgatcatctcgctgctcacgctgtcgcggtccttcgtgaacccgatcggccaggtctcgcagcagatgacgatggtcatgatggcgctcgccggcgcctcgcgcatcttcgcgctgatggacgagccgtccgagcaagacaatggcacggtcacgctcgtcaacgtcgagctcgcgtcggacggccgtacgatgacggagacgccgaagaagaccggtcactgggcgtggaagcgcgaggcgagcgacgacggcacgcgttcgcgcgaagccgcgaagaggctcagcaagcgcgcggccgaagtggccgaggaggcgcatgaagaggcggtcacgtcggccgacggcaggcttacgctgctgcgcggcgacgtgcgcttcaccgacgtgaccttcggatacaacccggacaagccagtgctgcatgacatcacgtggttcgcgaagcctggccagaagatcgcgcttgtgggcgcgaccggcgccggcaagacgacgatcacgaacctcatcaaccgcttctacgacatccaggaaggcatgatcctctacgacggcatcaacgtcaagggcatcaggaagccggacctgaggcgttcgctcggcatcgtgctgcaggacgtcaacctgttcaccggcacggtgatggacaacatccgctatggcaagctcgacgcgaccgatgacgaatgcatcgccgcggcgaagctcgtcaatgcggactcgttcatccgcatgctgcccgacggctaccagacggtgctctccggcgatggctccggcctgtcgcaaggccagcgccagctcatctcgattgcgcgcgctgcagtcgccgatccgccagcgctcatcctcgacgaggcgacatcgtcgatcgacacgcgcaccgaggaagtggtccaggccggcatggacaacctgatgaagggacgcacggtgttcgtcatcgcccaccgcctgtccacggtcaggaactcggatgtcatcatggtgctcgaccacggccgcatcatcgaacgcggctcgcacgacgagctcatggaggaaaagggcgaatactaccagctgtacactggctcgctcgaactcgagtagcgggccccggtaaagcgaaagcgcggccgtgtgcaatgcacggccgcgctttggtatgtgcgggacgccgcgcgcggcgatttccctatctgcgcaaccggccccaacgtgctgtaatggatagcaggcaacccgtttaccagtaaaggaaggtcaccatggttgatatgagcgacaagatgaaggagaacttcgaagagatcaaggcccgcatcgacgagcacaaggatgatttcgaagacatcaagaagagcgtcggcgatctgaccgacaagctcaaggacgtcaaggaaggctgggagacctcccgtgcggaaaagggcgacaagaaggaagtcgccgagcacgaagagacccaccagacccactgatccgccgaaccgcccgcgcatgcgccccagcaggggagtgcatgccgggcgaatcgacaccggcgtacgtacgaagccccttgccacacataggcaaggggcttccttatacgctgggcctgcacgcatgttccccactgggcaaagtccgccgggcgccccttttgtacgaggctatagtggggggataggaagcggggcgacacgcacccgcgccgctctcgagattggagccatcatggcagagcaacagaacattccagacaccaacacacacgaaggccttggcgcggtgagcgccgatcaggtcaagcagatggagcagattgtcagcgacactgaccatccgtacaccgacccgatcaccggcaagccgaatgaggacattccggaaaacgaggtgggtgtgagcgatgcctccaaggaagccaagcaggatgcggcgcaacgcgaggagctcgcaatcgaccgccccgaggagaccgacaacgaaaaccagtgggaagacccgtatctcgaagacaagtgagtcgctgacccacctgagaggagccctatgcgcgtagtgtcacgcaaactgccgttgcccaccgtggagaactgccgcgatctgggcggcatccacacggagcaagggcgcatggtgcgcccgggactgctggtgcgctcggcgaacctgcacgatgcgcgccatgacgacctggagacgctggcgcataggggcatctcgaacgtcatcgatttgcgcaccgatcccgaacgcgacctgaagccagaccgcttgctcgaggattggtcgttctacgcactgcccacgttccgcgagacgaaggcgctgcgtttgcagctgcgcgacatcgtcacccgcccgggcacgttcatcgaggacctctacccgcgcctcgtgctcgacgacgccgcggtcgcgtgctggaagcggatgttccgcctgctcatcgacgagccgggcggctacctgttccactgcacacagggcaaggatcgcaccggcatcgcggcggcactcattctggccgcgctggaagtgcctgaagacgtgatccgcgacgattacctgcagaccaacctctacatgtccacggaaatgccggcgttcgtcgacaccttcgaagcactgctcggccccaaggcccatgcggacatcgacgagttcctcgtcgcctcgccgctctatttccagacgtatatcgacgccactgcatcgttcggcggccccgtcggctacctgcgtacggcgattgggctcagtgaggccgacctgcgtgcactgcgcgatttctacctcaccgatgacgcaagtaactgaagcgcttatggtgttgtgctgattgggaaaacgtgagacgctgcgcgtggggcagtggaaaagacgctatagtgagcatatcgtcatcgacgacgagagtcgattgttaaggagaaaccgaacccaagaaagcggaaggactcaagggactcgacgccgcacaagtcgaagaacttcaagaggtggtcagcgaaacggacaagccgcaggccgatccggcaaccggcgagccggaagtggacgccgagggttgtgcaaccgcccacaagcacaaggtcgccgaacagaacgagaaagacctgctgttcgagtccgcggacacctggcagcacatggaagtccccgagtgaccgatggcacatagtgccgcgaacaccagaccaaccatcattcgtgttcccctgcaatggcccgcccatcgagccgccccattccccagggcacaccacgccgcatgcgtgagggtgtgtgagtcgaacggaaggcgtgccggggtgggtcattcgtgtttcggggtcgcattcgttcccgcgttgctggtatagtggcgcaagaaaccaggcagtgatccgtcatcagcggggagccttcggaagaacagccgggcggggcgccgcccgacccagtagaaccgacggggtcggcccgtacagccgaacacaagcggtcacgcgtgcatgcacgcccgcgtggcaagcgaggtggtaccgcggtggcgcgggggttggcaagcaatccgcccggagccatcgtcctcgcaggaaaagacagatcctgcaagatgaggagcaatggtgagcgaaacaccacagcacgtgtatcccaaggcatcggtcggcgaacaaagcgcgaacgtcgcgccgaatcccgacttcccgcagctcgaacaagatgtgctgcgttattgggacaccaacggcaccttccagaaatccatcgacgaaaaccccagtggtgagcacagctcgaatgagttcgtgttcttcgacggcccgccctttgcgaacggactgccgcactacggccatctgctcaccggctacgccaaagacgtggtgccgcgctaccagaccatgaagggccggcgcgtcaaccgcgtgttcggctgggacacgcacggcctgcccgccgaacttgaagcgcagaaggagctcggcatcgactcggtcgaccagatcgagcagatgggcatcgacaaattcaacgacgcctgccgcgcctccgtgctcaaatacgtgaacgaatggcgtgactatgtgcaccgccaggcgcgctgggtcgattttgaacacggctacaagacactcgacatcccgtacatggagtcggtcatgtgggcgttcaagacgctgtacgagaaaggcctggcatacaagggctaccgcgtgctgccgtactgcccgaaggaccagacgccgctgtccgcgcacgagctgcgcatggacgccgacgtgtaccaggaccgtcaggacacgaccgtttcggtcgcggtgaagctgcgtgacgaagacgacgcctacgcggtgttctggaccaccactccgtggaccgtgcccacgaacttcgcgattgtggtgggcgccgacatcgattacgtggaggtgcgccccaaggaaggcaagttcgccggcaagaagttctacttcgccaaggccttgctcggttcctacaacaaggagctcggcgaggactatgaggtggtgcgcgagctcaagggctccgacatggtgggctggcgctactacccggtcttcccgtatttcgcgggcgagcaggccacggccgaaggcggcacccccggtccgaacgcctaccagatcctgaccgccgattacgtcgacaccacggaaggcaccggcttggtgcatcaggcaccatacggcgaagacgatatgaacacgctcaacgcccacggcatcgcgagcgtcgatgtgctcgactctggctgccgcttcacgtcgctgtgcccggactacgaaggcatgttcgtgttcgatgcgaatctgccgatcctgcgcaatctgcgcgccggtgacggtccgctcgccgagcgtccggagtccgagcgcgcgttgctgttccaggagaagagctacgtgcactcctacccgcactgctggcgttgcggcacaccgctcatctacaagccggtctccagctggttcgtgagcgtgaccaagatcaagccgcgcctgctcgaactcaatcagcagatcaactggattccggagaacgtgaaggacggccagttcggcaagtggctcgccaatgcgcgcgactggtcgatctcgcgcaaccggttctggggttcgccaatcccggtgtgggtgagtgacgacccgaagtacccgcgtgtggacgtgtacggttcgctcgacgagctcaagcgtgacttcggcgactacccgcgtgacaaggacggcaacatcaacatgcaccgcccgtggatcgacaatctcacgcgcccgaacccggacgacccgaccggcaagtccacgatgcaccgcatcaccgatgtgctcgactgctggttcgagtccggttccatgccgttcgcgcagtaccactacccgttcgagaacaaggagtacttcgagcaccacttcccgagcgacttcattgtcgaatacattggccagacccgtggttggttctacctgctgcatgtcatggcgaccgcgctgttcgacaagccggcgttcaagaacgtgatctgccatggcattgtgctcggagacgacggtcagaagatgagcaagcatctgcgcaactacccggatgtgaacggcgtgttcgacaagtatggttccgacgcgatgcgctggttcctgatgagctcgccgattctgcgtggcggcaacctcatcgtgacggaggacggcattcgcgacacggtgcgccagatcatgctgccggtgtggagctcgtattacttcttcacgctgtatgccaatgcggcgaaccacggcgatggctatgacgcgcgcacgctgcgtgccgacgaggtgcccggtctgccgcagatggaccgctatctgctcgcccgcacgcgcaaactcattgcgaacgtgaccgagcatatggacaacttcgagatttccgatgcctgcgacgaggtggcggatttcatcgacatgctcacgaattggtacattcgcaatacccgcgaccgcttctggaacgaggatgagaacgcgttcaacacgttgtatacggtgcttgaggcgttcatgcgcgtgcttgccccgctcgccccgatggaggcggaggccgtgtggcgtggtctgaccggcggtgactcggtgcacttgggtgactggccgtatctgactgatccgcagaccggtgtggataccgcgctcggcaaggtgctcgttgaagacggcgcgctggtcgaggcgatggacaaggtgcgcgagatcgtttcgtccacgctgtcgctgcgcaaggcgcataagatgcgcgtgcgccagccgctcgccaagctcaccgtggtcgtcgacgatccttcgcaggtcgatggatatgacgcgttgctcaagagcgagctcaacatcaaggcgatcgactattcgacgctggatgaggccgccgagcatggtctgaagatcatcgacgagctcaaggtgaatgcgcgtgccgccggccctcgcctgggcaagcaggtgcagttcgcgatcaaggcgtcgaagagcggtgactggcatgccgaccctgtaaccggcgacccggtgatcgagacgccgaacggcgagatcacgctgcagggcgacgaatacgacatcacccgacgcgtggaagaggcggacgccacggcacggcgcgattccgcatcgtcgatcctgcccagtggtggattcgtgatcctcgatctggagctcaccggtgacctgatcgccgaaggctatgcgcgagacgtggtccgcgcggtgcaggatgcgcgcaaggaggccggcctcgaggtgtccgaccgcatcgcgctcacgctcacggtgccttccggtgacctgccgaaggtggagcagttccgcgacctgatctgctcggagacgctgtccacgtcgatgcaggttgagcaaggcgacgccctcggggtgcatgtggccaaggcgtgatccactgaccacctgcccacagggctcgatgacgccggtgcgacgcacgaaaaaagtgcgacgcaccggtgtcgtttttcgttcacctgcagaggggaaaatgaggattattttttgcttatgatgaggggtagcaagcacagacttggattctctcgattatggcgctttcgatgaggaagaggtgaattctagtgattgttgtaacaccctcgagatttggaggttgcaacgatgggttacgagttcgatggcgtgcggtatgagaaacttcgcgacatgcgtgaaacccgacgcgcgagatatgtgggtctgtttgaggcaggtatgaacttcacacggaccgcgcatgcgggggggggctccgtgttcgcgcttgcgatcgccgtggcgatcgtggtgcgccgccgcgcgaaaacgccggcgtggagtgcgtgcacactgagcatgtatagggcaaccatgttcattgtgcgcaataaaacgatgagacaaccgggcagcctgccggcacatcggctatattgataccaatactcacaacgaggttaggatgttcacatgccaagagctggtgccggttcagggtctggccgatcgtcaagcggccacgacggtggttcacgcatgtccagcgggcatcggccgagcatgccgggttcgggccggcgcgccgggggcggtggctcggccggattcccgcagtccagcgggtccactggctcgggcggattcgatgtgggcgatctgttccgggcggccggcataggcatggcaggtggctacaacgcagggcggcgttccacccgcaaccgctacggccgtcgcagcatgccattccctgaagagatcttcgacgcgatggggcagcagccgaactacggccgccagcagacgcccggtccatattcggcaggccccttcggcacgggtgcgccgggcgcggggcaagggccgttctcgccggccggtgggccgccggtggccccgcccaccatgcaaacgccgttcggaggcaacaacaacggcgggaaaaagcccaatggagggctcaccggactcatgccactgatcggcatcctggccgcgctcgtcatcttcctgctcattttcatgatgcccagctgctcgaacaatgagcccaaccgcaatgattacaacgtgacggtgccggaaagcacgtacaaccgcaccaagctcgattcagggctgccgtacgattcgaactgcatcgacgaccagctcggctggttcgagaaccgcacatccgcggcgaaacgcctcaaggtgttctacgacaagaccggcatacagccgtacatcctgttcgccaaatacaatccgcagctgaagaccgatgatgagaaacaggcatgggcgcgcgaatggtacgacgaccacatcgacaatgaggacacgctgctgtttgtgtatttcgccgagcaggacgtggacaacgacgttgggtatatgacgctcgtcaacggcaagcacgtctcgagcatcatggacgcccaggccactgagatattctggacgtaccttgatgagtactggtacagcgaccggtccaccgatgacgcgatcgtggccacgttcgattcgactgcggaccgcatcatgaccaagacgaccacgaagaacgatgtgcacaagtgggtgatcatcgcagtcattgtgatcggcatgcttgccattggcgccgtgatcacatggatgctcatcaaacgcaaacgcgagcacgagcagtatgtggagcgtatggtcaccacaccgctcgaagaggcgcgcgatccgattttggaaaaatatgatcaggcagatcacaacgatcaggttggtcaggaacagaaaggacaatagccatggctattctcaaacgattcggcgacatcatgcgcgcaaacatcaatgcgctgctcgacaaggccgaggatccggcgaagatggtcgaccagatgctgcttgacctcaacgaagacctcgcgtcggtcaagaaggagaccgcgagcgtcatggccgcggccaccaacgcacgccagcaggtcaacgactgcaaggcggacatcgccaagtacgaggcggccgcgaaggccgcggtcaaggccggcaacgacgacgatgcccgcaaactgctcgccaccaagcagcagtatgagagcacgctcacttcactcgagaccgccgccaccgtcgccgaagacaatgcggcgaagatgcgtcagatgcacgacaagctggtcaacgacatcaacagcctgcaggcacgccgtgccgcggtgcacgccaaggtctccgtggccaacgcgcagcagcacgtcaacgaagccaccgagaagaccgccaaggcctcccgtggcaccgccgcgttcgagcgcatggaggagaaggccgaccgcatgctcaatgaggccaacgccacggctgagctcaacacgcaggcaagcaacgaagacatcgccaacaagtaccttgccggcggctccgcatcggtggacgatgagctggcccgcctcaaggccgaggtcggcgtggaagagcagcaggaggccgccagcgactgaagggatgcgccgtccgcataaggatgccgcatatgcgaatgccgggaccctcgatacgggtcccggcattccttgtacctccgtggcggagcctctggctggccggttaggctgtctggttgatcttggcgcggccgtgcctcaccatctcgcgtgaataccataccgacacaagcaacatggccacctcgaagatcgcggcgatgaggatcgaatgctggaagccgttcgcgtatgcggcatggcggttgacgccttccgcggtctgcctgagtacatcggcggaaagcacgccgacgaacagcgctgacccgatcgaacccgcgatctggttgccggtcgagaagatcgcgctcgtgtcgggcaccgtattgtcgggcagcgcctcaagcaccacatccttgtcgggcacgttgatgagcgcgtcgccgacaaccacaacggatccgatgagcaccacgagccacgcgatcttggtgggggccgcgaagaacgtggcgaacaggccgatgaccatgagcaggaagccgctcgagacgaccggccacatgccggaacggtccacggtcttgcctcccacaatcaccgaacccgaatagaacaacgtcatgatgagcaggaaacagccggccacgaacggcgtgtaatcgcacgcgcgctccaagtacagcggcaacagcaacaacacggcctgctggcccatcgcgccggccatatacatgagcacaccaagcgagacatacagatgcttcatcgggtgcaggtcgagcaatggcacatccaaatggaattggcgcaccgcgaaccagacaagtaccgccacaccggcgatgagcatcggcacggcgaacagcgggcggtgcgtcagctcagagaagcccatcatcagcgcggccaagcccacgaacgagagcacgatcgacagcacgtcgatcggatgctgcttgcgcggttcgacgtcgaacatgaacttcgcgcccatgaggatcgagatgatgccgaccgccaacggcaccacatacatcgacgtcaggctcacataggtcaggaacacgccactgagcaacggcgccaccgcgatgcccagaccgatgatggcgctgttgagcgacaccacacggccagagatcttggctggtaccacacggatgatcaccgtgttgattgttgggaacatgagtcccgacccaaccgcctggatcaggcggctcgtgagcatcatcggaaaattcagggagaacaggccaatgagcgaactgacgatgagcagcacgcggctccagaagaacagtttcttcaagccgatgcgcgcgagcacagtggcggcggtcatcaccgccgtggccgcgacgatcgcatagccaaccgtcacccagttggctgtggcgatgctcacatggtaggtttccgagatgttcgggagcgcgaccgccatcatcacaccgcagaagccgtcgccgagcgtgctgacaatcagcgtggcgatgagcaatttgaccgatttccaactgtgctgttgaccgtctttggcggtgatcatctcatcgttcgcaattgctcccatatgccatcacttcgtgatttcgttgtacttcggtacgcccatgtaattgaatccgacatgctgcacatgctcgccggccgccgcggtcacattcgcataccacagcggaatcaccggcagatccttgaacagcacctcttcagcctgatgatagtagctgatcgcatcatccacgttggtttggcgcgcggcgtcatcgatcagtttgtcgaaggccgtgctcttgtaatcgccgttgttcaggcccttgccgtcggccgctgacgaatcgtaggcctgcatcaggtagccttccggatatgggtagtcggactgcaggccctgcaggaatgccgcgttgatcgtgcggtcgtggatcgcgctgctcagctccttctgcgtggggatgatgtatggctgcgcgtcgatgcccaaggcgttcttgatggagttcgtgatgccctccacgcgctgcttgtcgccgctgtccgcgctgtaggcgaggcggaacgtgccgctccacgggctgattgcatcggcctggctccatagtttcctggcggtttcggtgttgtagtcgagcacgtcggcgcctttgaggcttttggaataaccggcgatcgtcggcgcggtgaaatcggtggccacggtcgcggtgccgtacatcaccttctcgatgatgttggcgcggttcacggcatggctgatcgcggcgcgacgcaggcgtccttcctccccggagaaatgcttgagcttctgcggaatggtgaacgaacggaacgccggacccggcttgttgaaggcctggatgccgttttcgtgctggtatgtggcgagcgcggaggtggggatggtgtcgatcacgtcgagattgcctgattccacatccgcatacgcggtttgcacgtcggtatagagctcgaaggtgacgccgccgttcttgggtgtgcgcggtccggtgtatttcgggttcggcacaagctggatgctcgaatcatggttccattgcttgagcatgtagggaccgttgccgatcgggtgttcgccgaacgcgttggcgtcggcgtatgcgctttcggggatgggcaggaacgccacgtcgcccactttgtaggggaaggaggagtcgggcgcgttgagcgtgacctgcagggtgtggtcgtccaccaccttgagtccgctcaattgcgcgtcgttgccgccattggtgtcttgcagcgcgtcatagccttggatcgtggagaagatcgcggcgccgagctgcccgttcgcggcgttcgcggcgaacgaccacgccttggcataggtctgcgcggtgatcttctggccgtcggagaaccgcagaccgtcgcgcagtgtgatcgtgtactgtgaggcatcgctgttcggggtaatcgattcggcttcggcgtagatcaattcgccgtcgtccgagaacgtgacgagtccttcgaacagctgggtcacgaccttccagctggccatgtcgttggtgttgccgggcaagaggttggcggagggttccacgttgttcaccgtgatcaccgaagtggttgcggtgcttgatgagccttgcgcgctgggggagccggtgccgccgctggtgccgcagccggccagcagcatgccgagcgccgcgatggaagcgaccgcggcggtgacgtgtgcggacgggtgtgaaaaacggggatggaacacaatggcacctcgggacttgcgtatggttgtgatggatgttcggcgcgtctctttgcgcgcctgccctcaacctaacaccgcgttccccatatgcataggggcttcggtgctgcgcggaaaacgggaataatgcatgttgccatcgtgttttggcgtgcaagccaatgccatgcggaatcgccaaaaaatgacggtcgaatatacgcttgtagcgtcgcttggcacggcgagatgcgggatgcggtgtaatggggataggcccagatgggctacagactactcacacgaaaggtggtcgttatggcagacgaaaagaagccccacgaaacgctcaaagagaggttcgatgactttaaggccgatgtggacgtgcataaggccgagcatcaggagaaggatgcgatcaaggacgtcgaaagggccgccaagcacgacgccaagtcggacgtggaccttgacaaggccgcagccaatgtggacaaagccattgaacgtgaagccgaagccaaggaaggctgatcgattccccatatattgttcccattggtgaggaaaccataagcgtgtgagtcatacggccccacaccgtgtaattcacatggggaattatattgcaacagtatcccgcctcgtttggaggcgggatactgttatatggagtgcatgccttcagaaaacgaactcaccgccgcactgatgcgcctgtgcgacggtccggatgaccacgctcgactgcacatgcaagcacgcgcgaaccatgggcacgtggtcacgctcgactgcgactatgacgccgaaggcctgaccgccacattcatcgagcaagcggccgacgcgccaaagtcgcagcgcatcctgacgacgatgcgcgcggacacgccttctgcgtcagccgcacggcgcatcgcctacgcctaccgggacctcatcggcaccgtcggcaatccgcctgccgtgactgttgatctactcgaacagcgcatcgtgcggatcgcgcccattgtgctgcctgaatctcagctcggaattgcaccgccggtgcgtgtggccgcgagcgcggaagacccctgcgcgttcgaactgcacagcgcagatgcacacgcggcgccgaacgcggccttgctgcggttccatggcacggcagccaacgggttttcatgcgccacgatatggcgtctcgaagacgggtatgcgtcctacgccatggtcgactacaccgccgggccgctcaacgacatcctcgtggatgtgctgtgcacactgcgcttctacgcggtgcgcggttgggtgtgacaccatggcacattgcgccgggcgcacaaccggccgggcggaacgaactatctgttacgctctgatgtcggcatgcatgcacacaacaggagtggattgacgatggcggacagcgggcaacacgcatccaatgcgccggcgatggtggagggttccggtgcggcggccgcggggccgcgcagcacagtggggttcgtcggcctgttcgcgcttgtggtgtcggcgatggtcggcggcggcatcttcagcctgccgcagaacatggcacagcatgcgtccgccggaggccagatcgtggcatgggcgatcaccggcgtgggcatgtggttcatcgtcaacacgttccgtgtgctcacccacgtcaaaccccatatgcaagacggcctgtactcctacgcgcgcagcggattcggcgatttcgtcggctttcttgtggcctacgggtattggctgtgcaactgcttctcattggtggcctatggcgtgctcatcatgtccacgctcgacatcttcatgcccggcacgttcaccaacggcaacaatgtggccgcgacaatcggctcgtcgctgattctgtggctcatgctcgccgtggcattgctcggcaccaaaacgggtgcactgatcaatgtcgccggcaccgtgtgcaagatcatcccggtcatcgtgttcgtggtggccctcgccgccgtattcaaaaccggcgtattcctgcgtgggttctgggggctgggggcccaaggcacgccgctcgggttcgacgtgcaccgtatcggtgcacaggtgagcgactccatgctcgtcaccctatggctgttcatcggcatggaaggcgcggtcgtggtctccggttcggcgcgccatccgcgtgacgtctcccgtgccacaaccgccggctatctcaccgtgctcgtgctctacatcctcgtttcactgctgccgctcggcgtatattcctccggccaggtggcgcggatgcccaatccctcgatgtcggtgatcatggaacagtgctttggccaggggggctccatcatggtcaatgccggcgtgatcatctccgtggtgttcgcatggctcgtctggatgatcatgatcagccagatgccgttgtatgccgcgcgcgatggcatctacccgaggtccttcctcgccaccaaccgcttcggcgccccatccaccggcctggtgtggaccgccgtcacctgccagctgctgctcattctctgccatttcgtcaacggcgacgcctgggatgtcatgatctccatcacctcggtcatggcgatgccatgctacctgctgtgctgcgtgtatctgtggaaaatcgccgtacgtgagcccccggcattccccagtgcggcagcccgccgccgtgcgctcgccaccggcgtgctcggcacgctgttctcgctgttcctcgtctactccgcgggcctgcggtatctgatgatggcgtgcgcgttgtatgcgattggcctgccgctgctcgtggtggcgcgccggcagcgccgccctggcgtgccactgcgccagctgttttcgcataggggctgggttgtattgtcgcttatcgtggtgttgggtgtgtgcggtctcgtctacaccgtgcacggtggcgtgttcggggtggcatgacgcacattgcgcacggaaaggagacttcggtgaagcggatcgtaacgggaatcgtggcgcatgtggacgccggcaagaccacgctgtccgaggcactgctgtacgccactggcaccacgcgcagactgggccgtgtggaccacggcgacgcgttcctcgacaccgatgcgatggaacgcgcgcgcggcatcaccatctacaccgagcctgcggtgatgcgcgtcggcgaagcggagctcacaatcctcgacacccccggccacgtcgatttttccgcggagaccgagcgcacgttgcaggcgctcgactacgcgattctcgtggtgtctgcggccgacggcgtgcagggccatacacttacgctatggcggctgctgcggcgctaccatgtgcccgtgttcgtgttcgtcaacaaaatggatgcgccgggcgccgaccgcgcgcgcatcctcgaacagctgcacgcgcgctgttcggacgcgtgcatcgatttcaccggcgcggcggatgcgctgtccgaacgtcagctcgacacgctcgcgatgcagagcgaagccgcgatggacgaatatctcgagacaggcggcatcgacgtgcgcacagtgcgcgcattgatcgccgacggcgcggcggtgccggtgtattttggctcggcgctcaaaatgcagggcatcagtgagttcgtggaaggctttgcgtttttcacgcgcgaaccgcactatactgccgaattcggggcgtgcgtgttcaagatctcgcacgaccggcagggcaatcgcctgagctggatcaaagtgaccggtggcgagctcaccgccaagatgatgctgcccgaagcgggcggcgccgagaaagtggaccaagtgcgcgtctactccggcgcgaaattcaccacggtcgagtcggtgcccgcgggcacggtgtgcgcggtcaccggaccggcgcacacattccccggcgaagggctcggcgcggcgcgcaatgcggcacagccggtattgcggccggtgctcacctacacactgctgcctgggggcaacgatatgcacgcgtgcctgcaggcgttgcgcgagctcgaagacgaggagccgctcctgcacgtggtgtggcaggagcggctgcaggaggcacatgtgcagctcatgggcgcagtgcagctggagatcatcgaacagctgatgcatgaccgtttcggtcttgacatcgccttcggcccggggtcgatcctgtatgcggagacgatcaccgcgcccggcgaaggcgtggggcatttcgaaccgttgcgccattatgcggaagtgcatgtgctgatcgagcccctcgagcgggggagtggcttggagttcgccaccgatgtgagcgaagacgagctcgaccgcaattggcagcggctcatcatgcagcatctgcaggagaccgagcatccgggcgtgctcatcggcgcgccgatcaccgacatgcggctgacgctcatcggcgggcgcggacacctgaagcacaccgaaggcggcgatttccggcaggcgacataccgcgcggtgcgtcaggggctcatggaggcgcgcgaagcggggcatgccgtgctgctcgaaccgtggtaccggttccgtcttgagttgccgcaggagatgctcgggcgcgcgttgagcgacgtgcagcggatgggcggcgagagcgcggccccgcagattgaggatgggcttgccgtggtggaaggcgcggcgccggtgagcgaaatgcgcgactatgcgatggacgtgaacgcatatacgcacggcgaagggcgtctggcgctgatgttcggcggatacagggaatgccatgacgagcagacggtcgtggatggggcaggctacgacccggaggccgatctggagcatacgccggactcggtgttctgcgcgcatggcgctggatacacggtgaagtggtacaaagtgccggaattctgccatgtgccaatgcgcaggggagttggcataaaccgtctggaacagtgagaaaaagagagcggacaacgggactcgaacccgcggtctcgaccttggcaaggtcgcgctttaccaactaagctatgtccgctaaggcagtgcacggtgtgcagcctggtgggcgatacaagattcgaacttgtgaccccttccgtgtcagggaagtgcgctaccactgcgccaaccgcccgaggcgagtaacaacatacgtcatctggcggacaagtgcaagtgcaatgtccccgccgacacgcgtgaggcatgtggtgagcctttggaatcattggttcgagggacgatatggcggttttgtgtgcatggttggaatgttgccgacctcagattgtgcccctggcgttgcccccggtattgccccaagtgttgcgccccggatgcgcggggcagagtttcgtcactgtcgcacgctcccttacgttcctcaactctgccccgcgcatccggggcgcaacttgcacttctcctccacgaatctgggtgtgagcaactctgcccgcgcattcgaggcgcaacacctgcggtgacttttctgtggtgtacggatgcgggtgatggctgctgtgggatccgcctcctcggtgggcgatactgccgtggcgggggctggcgtgcttcttggcggtgagcctgcggctccgtcggcatcccgcccgacggccgtctgttctgcagtggtcgtctgttcgcggggcgcctgttggagggattttcttggttgtgcgtcctgttcttggctgtgtcagcctgcgtaatttgggtcgtttggggcgtgggtttcgtctcctttcacgtctggggaaaaggtggggtgggggttgtctcctgtggtggtttctcccttgtgtgtttgtggattggtttgtgtctttgtgggtgtcgtgggggggggtggttggggtttggctggttttcgacacgccggtggtggtgttgtgtttgttggggtttgggggtgtgtggttgggggtggggttgcgtgggtgggggttgtggtgtaggtttttcttttgctgccgctcacggcctgccggggttcccgggtcggggttgtgggtgtgtggtggtggtttgagaactcaatagcgtgtactgtactacttgaccaaggttgatgtcgcttcggctgtcgtggccgttgtggttcttggtcgtcttttatgatgccagttccgttgtccgcctgcatggtttcgtgtgggtaatcctgtcgggttttgatggatggcggaggttttttgtgtggctccctttccttattagggggtccgtctgatttcttttgaaatggatttgagagtcgtttttggctttctgcaatgttttttgtggagggttcgattctggctcaggatgaacgctggcggcgtgcttaacacatgcaagtcgaacgggatccctggcagcttgctgtcggggtgagagtggcgaacgggtgagtaatgcgtgaccaacctgccctgtgcaccggaatagctcctggaaacgggtggtaataccggatgctccgctccatcgcatggtggggtgggaaatgcttttgcggcatgggatggggtcgcgtcctatcagcttgttggcggggtgatggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcgagcgttatccggatttattgggcgtaaagggctcgtaggcggttcgtcgcgtccggtgtgaaagtccatcgcctaacggtggatctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggatcgccgtggagacacggtttcccttcggggccggttcacaggtggtgcatggtcgtcgtcagctcgtgtcgtgagatgttgggttaagtcccgcaacgagcgcaaccctcgccgcatgttgccagcgggtgatgccgggaactcatgtgggaccgccggggtcaactcggaggaaggtggggatgacgtcagatcatcatgccccttacgtccagggcttcacgcatgctacaatggccggtacaacgcggtgcgacacggtgacgtggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggtagcacccgaagccggtggcccgacccttgtggggggagccgtctaaggtgagactcgtgattgggactaagtcgtaacaaggtagccgtaccggaaggtgcggctggatcacctcctttctacggagaatatgggcgtgcatggttttgtgcacggttttgtggctggggtttgccgagtgcgatggtttgtcgtcgccgccctggcttgctggcgtggaagagtcgtattggattgtgtggtgtggtgcgtgctgttgggttccctggccgccaccggcccctggtgtggggtgtggttgccagtgtgtcccccaggtcggttgcccggtgcctgttggtgcggggtgggtgtcctggtggggtggtggtttgagaactggatagtggacgcgagcatcggcccgcccgttggggtggggttggtgttcgtactgtgattcggatccgaggaattgttttttcttgggttcgttcgtaatcgtatgggggcgtgccgtgtgtggtgcgtccccgtgatctgatgtcgttctagggtttttcagtagtgctttggtcatggcggccgtgttgtggttgtcgtgatgggcgtatggtggatgccttggcagacagtaccgatgaaggacgtgtggggccgcgatagtcctgggggagccgccgacatggctttgatcccagggtgtccgaatggggcaacccgccagccgtcatgggctggcaccgcacttgtgcggggggtacgcagggaagtgaaacatctcagtacctgcaggagaggatactccgtgagtagtggcgagcgaaagcggatgatggctaaaccgtgcgcgtgtgatacccgtcgggggttgcgcgcatggtgtcgtgggaacgcctgtccaacggccgacgccgttggctgtggtgataaatgcatgcgtgaggcgaaccgggttggataccgggccgtagagggtgatggccccgtagccgtatgcgcgtgcaccatggatggtgtctcccgagtagcgcgggactcgtggaatcccgtgtgaatccgcccggaccgtcgggtaagcctgagtatacctgtctgaccgatagcgtacgagtaccgtgagggaaaggtgaaaagcaccccgggaggggagtgaaagagttcctgaaaccgtgcgcccgcgaaccgtcggagcccccttggtggggtgacggcgtgcctatcgaaaaatgagtctgcgagtcagtggcatgtggcgagcataagccgtgtggtgtatgcgtagcgaaagcgagtcttaaaaggcgtcttttcagtcgcgtgtcctggacccgaagcgggatgatctagccctggtcaggttgaagcgcgggtaagaccgcgtggaggaccgcacccacttaggttgaaaactgaggggatgaactggggttaggggtgaaaggccaatcaaattccgtgatagctggttctcttcgaaatgcatttaggtgcagcgtcggttgattgcgtgtggggggtagagctactggatgcttgcgggcccgtgccgggtaccaacagcaaccaaactccgaatacccatcgcgtctattccggcagtgagtcggcgggggataagctccgtcgtcgagggggagacagccctgaccgtcgtctaaggtccccaagcgcgtgctaagtgggaaaggatgtggagtcgcatagacagccaggaggttggctcagaagcagccatccttgaaagagtgcgtaacagctcactggtctagtggttccgcgccgacaatgtagcggggctcaagcacgccaccgaagacgcggatgcggccgtatggccgtgtggtaggagagcgtcccacaccggggcgaagcggcgggggaacccggccgtggactgtgtgggagtgagaatgcagacatgagtagcgagagcagggtgaggatccctgccgctggaagaccaagggttccagggccacgttcgtcgtccctgggtgagtcgggtcctaaggcgaggccgacaggcgtagtcgaatggatgaacgggtcgatattcccgtaccggctttcggaccgaccaacagcccgtgtgaacaagggccatccgatacggttgatgggggcttcggcctcctgattccgttgctgtttggcctggacgcgcatgggttgagcgtttcaggagtgacgcggacgggtagccggccggggaggtggttttccctggtcaagcgtgtggccccgcccccaggcaaatccgggggcttcatggggtgaggcgtgatgatgggcgctttcatggcgtgatatccggtgatcccgtcggccgagaaaagcttcggcgcgaggtccgttgccgcccgtaccccaaaccgacacaggtggtctggtagagtataccgaagcgatcgagcgaatcctggtcaaggaactcggcaaattgctcccgtgccttcggcataagggagacccccggccgtgccggccccttgcgggtcgtgggcggctgggggtggcacaggccagggggtagcgactgtttaccaaaaacacaggtgcatgccaagacgcaagtcgccgtatatgcactgacgcctgcccggtgccggaaggttaagaggatccatcagcgtcccctcgcgggatgcgaagtggtgaattcaagccccggtaaacggcggtggtaactataaccatcctaaggtagcgaaattccttgtcgggtaagttccgacctgcacgaatggcgtaacgacttccccgctgtctcgaccaggagctcggcgaaattgcagtacgagtaaagatgctcgttaagcgcagaaggacgaaaagaccccgggacctttactataccttggtattggcatcaggtgcggattgtgtagcataggcgggaggcttcgaagccgcggcgccagccgtggtggagccggccagtgaaataccgctctgtccccatctgatgcctaacccggacaagtcagccttgtcggggagagtgcctggcgggtagtttaactggggcggttgcctcccaaagagtaacggaggcgctcaaaggtccgctcggcccggttggcaatcgggtgtcgagtgtaatcgcacaagcgggcttgactgcgagatcgacggatcgagcagggacgaaagtcggagatagtgatccggtgccggcgtacggacgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatcctgaggaggcctgcccatagtacgagaggacctgggtggacgaacctctggtatgccagttgtcgcgccagcggcacggctggttggccacgttcgggagggataaccgctgaaagcatctaagcgggaagcccgctccaagataaggattcctgacaccccccccgggggtgtgtgagaccccatagagaacatgtggttgatagaccggacgtggaagccccgcgaggggtggagccgaccggcactaacggtcgaagacaaccaacaccaccatgacgaagccggaaaaccccggcggcatcacggcggcacgaacaccaagtccctcactcgcgtccacgatccggttcccgaaccgccacccgcagacaggataacagattttgcggcggccatggcccaggggagacgcccggtcccattccgaacccggaagctaagccctggcacggcgatggtactatgcccgagaggacatgggagagtagcacaccgccgcaaccacacttcaccgaaggcccggggaacacacgttccccgggccttccccgtatcccgggcacaacgcagaacccccgacacggacaccgccgaaccggggagcatatcacaccgcgcgatcttcatcccatgaacacccctccaaaccggaagaacaacaactcccgactattttctccccacctacatgcctctcctggggtcatttcataccttgccagcatatcggcaatagcatgcctattcagcaaagcaaaagcccaccgcatgagcgatgggcgaattgcatatgaaatcttgtgcaaaagatcacacgcacgtacgcatggagatgtctgccgagcgggtgtcaatataacgccgctgccattccaagcattggtacgtctgcgtggcgtcagaaagcgcgcggtgctcctcaacatcgccaatgccgtaacgctggatcagatcgacaagacgatgccgttcagaggggaacagcagtcggtctatatgcatggtgtcaatgggacgcacggaaaagcgtgtggagtcgctgaacacacgttccgcattggcaatgaggaatgagagatcgaatttggtgttatgtcccaccaaacggtcattctcggtccagtgtatgaaatccccgagtatgtcttctatgacgggctggtcttcgagcatctcgttggaaatgcccgtgagctccgttatgcgtgcggagacgcgcctgccgggattgacgagctgcgtgaaccgatccactatcttgccgtcgcgcactttgacggcgccaatctcggtgatacggtcattctgtgcgctgaagccggtcgtctccagatcgagtgagatgtaattcatggggattcgcgatgctggcttcatggccacctcgtttctaccgtctgcctgcagttccctgcacccttcttcttgccgaataaattactacttccattgtagtacgcaataaaatattcgtttttcttgtttaccagtctatcggaacacaccatgaacatacgcggcaaagtattatcgtcgcaattcatacgcaatcattcacgattccactataaacgtggggtcactgtgcgcgtgcagtaaaaaatatgtgtatagattataaagatggcgcttaaaccagctgcgggaactgtgatgtgattgtgcgctcgtgatccatgtatgcggttgtctcatgcatggccatggtgattgtcgcctggcgaatgtctgcaccgggagcgtcgtcgcgggcgtctgcagaggtggtgaatggcagacgcatctggtgccacaccgcattgccgtgcacggattggctgcggccctcgtcaatgaacccgaacgagctgtagaatggcaacattttctccttgcaggcgagcacgatgccgtgcctgtgcgaaagcgcgctgtcgagaatcacgtggcgcataaggaacgaggcacagccacgatgctggtacatgggtgcggtgttgacgccgagtatcatctgccaaggggcatcgtccgcatgcagggccgtggaggcgtacatatcgtcggtgaggtcgggtgagcccacgcatggcccgtcgatgaagctgacgagcatgccgtcgtcgacctgggctgggaagcagtcgttgtccggctcggcgggattcaccagaagccagaagtggtttggatagctctccactctgttggccagttggtcgatgtcggccgcctcctgcggagggaagcacgcggcctccactgctgccagcgcgtcgaggtcgtcaagcgtcgcatgtcgaacaagcataaggaacatactctctcagggcatacccaattgcgggcgaagcggtgttttcgcgcccgcgagctgaaatggcggcgtccgaggcatgaatggtgcggcagcgatgccgtgaggttgccatggacctcccaaccgggcggtatggatataacacgtattcgaatttgcttatacctaggcagatgcctgtgatttcaccagtattgagccgcatatcagttttggctatagccacgccggtgaatcgcccgccgccgcttcgtacagtgtcaactgtcggttcgagtaaagctccttgagaacgggatgcattgccgaacgggcagagagcaacgaaaggaagggatctcagtgaaatacgcgattctcggagcaggcggcatgggcattcagtatggcgtgctgttgcaggaattcgcacatcagcaggtggatttcgtggacacctggaccgagaacgtcgagaagattcgcgaacagggtggtgcctatgtgtcgcaggacggtgagggacgccacctggtgccgatcaacgtgtactacccggaggagtatgccggagacccggacgtatggatcgtgttcgtcaaacagcatcagcttcccgaatttcttgagcgcaccgcgccgcatttccgcgagcatcaggtggtgttctcggcgatgaacggctacgggcatttcgaaaagctcgccgagtacttcccgaagcatcgcatttatggcggaacggcgctgatcggcgcgtatgtgtacggtcccggtgatttcaacttcaccggaggcgcacatgcgaaggcgatgaacctgtgcgcgtacgacgagcatgatgtggaggaggatccaatcgagcggcagctgttcgccgatttccaggcggccacgctgaatccgaccatcgtgcggcatttcctcggcatgtgcctggcgaagatcgtgttcaactcggtgctcaacacgttgtgcacaatgtatcagattcgcttcggcgagttcgcctcgcaccccgcggctccgattctcaccgaacgactggtcgacgaggcatatggggccgccgaggccgccggcgtgcaattgctcggcacgcgggaaagcgaggtggagacgataatgcacacggcttcgattgcgcatccgttgcattatccgtcgatgtaccaggatctgacgagatgccggccgaccgaagtggactacatcaacggctacatcgcacgcctggggcgcgaacacggctatgcctgcccgctgcatgagttcgtgacgcaggaggtgcatctcgccgagcacgcgttcgccatccatcatcccgacatcgccgccaaggctgcctcacagtccgtggaactcgcagactgacacggcctccccaccgccatattcaatactcacagatttcatattcacggattgcctgacgctgcattgccgacgctgcccggaatccgcagtcacgagagaaagagaagacccatgaccatcgcaaccgcattcaccaccctgaaatcgaagcgtaggacactcacgcgcgccttcgccgctgtgcttgccgcggcgacactgcttggcactgccgcctgcggcaccgcgcagaacgccagcgccgaaggcattgccgaacctgtggatggcaagacgacgaaggtgacgatcggcgtatgcgcgggaccgtatggcgacatggtcgaggaggtgttcgcgccgctgctcaaggagaaggggtacgaggtgagcacgaaggtgttcaatgactacgtgcagcccgacaaggcattggcctccggcaagatcgatgcgaacctgatgcagcacggcaactacctgaagaagttcagcgccgacaacgatctggatctcatttcgctgggccagacgccgacgcttggtctaggcatctattcgaacaagtaccactcgatcgatgagattgcggacggtgccaccgtggccattgcgaacgacggttcgaatctcgcccgcagcctcggcgtgctccagcagaacaagctcgtgacgatcaaagacggtgtggatgccacgaaggcctcggtgaacgacatcaccagcaatccgaagcacctgaacatcaagccgatcgacgctgcccagctggctcgttcgctcgacaccgtggacgtctcgctcgtccccggcaactactcctgggccgccggtctcgacccgaagaacgcgcttgccctggagcagcaggacgacggggtgatcgaggtgttcgccattgccggccagaacaaagacacgcatttcgccaagacggtgcgcgatttgctcggtagtgacgaattcaggcaggccatcgccgccagcaagttcaaggacttcggcaagccggcatcgtgggccgagtgagcggcttaagtgaccgagacaatgcaccgcaggcatgaacagcgagggaacatgggtgtacagaacacggattccagcacgatcatcgaactgaaccacatctccgtcaccttccgtgagggcggccgcacggtcgaagccgtcaaggacgtcaccatgcatgtgcgcgaaggcgagatcttcggcatcgtgggcttctccggcgcgggcaagtcgacgctggtgcgcacgatcaacctgctcgagcggcctaccgagggccaggtgatcatagacggacatgacgtgaccgatctcaagggcggagcactgcgtgagcttcgtaagaagatcgggttcatattccagggattcaatctcatcgacaatgtgacggtgggcaggaacgtcgaattcgcgctcaaagcgggcggctggccgaagaaggggcgtcgcgcccgtgtggaggagctgctggacatcgtgggattggccgaaaaggcggacagctatccatccagtctgtcgggtggccagaaacagcgtgtctccatagcgcgcgcccttgccaactcgccgcgcatactgttgtgcgacgaggccacgagcgcactggatctggagaccactgaggagattctcacactgctcaagcgcattaacaccgaactgggcatcacgatcgtgttcatcacccaccagttcgatgtggcgaaggccatcttcgatgacgtggcggtaatggaacaaggtgtgattgtggagcagggcaccaccttcgacgtgttctcgtcaccgcatcacccgaccacgcaggcgctggtggagcgttatctgggcattgcgattcctgagcagctggtgccgcaactgccgcctgggcgactgatcgagctgcgttacagggacggtggtgcgttccggccgctcatcagcgaggtcgctcaacaccacgacgtgtcgatcaacgtgctgcacggcaatgtaggctacttcggcacgcaggccgtgggcacgctcatcgtgctggtcagtgcgcgacagggcggccagcagggggcgcagatcgtgcaggatgccatcgacgagctcgccgagcacgtccattcatggcgtgagctgagcgaagacctgaacgacgatctggggcattcggtggatgaggcattcgctggcgaagcggcggccgatcggttgatcggcacatacggcgacgtaaacgatgttcggacagacaacgaggaggtgctcgcatgagcgagacgttggagattctgcaagacaatctcggcaaagcgctgtgggacacgttcttcatggtgggtgtggccacattggtcggcgtggtgctcggcaccgccctcgccgtgttgctctacctcacgcagcacagactgttcacgccgaaccatgcggtcaatgagatggtcgggttcgtggtgaacgcgatccgctcgatgccgttcctcattctgctcgtcgtgttgattccgctcatccaactgctcatcggtgatccgtacacgcccaccggtggcgcgatcgcattgtcgattgccgctgtgccgttcttcgctcgcgtggcagaaagcgcattccaggaggtggatgaaggattgctcgaggcggcgatctccaccggcgccccgttgcggcagatcatcttcggcgcgattttcccgcaggcgttgcccagctatattcgcggcattgtgctcacgatcatctcgctgctcggctattcggccatggtgggcaccatcggtgccggcggcattggcgatctggccattcaatacggctacaaccgttatgagaccggcgtgctcgtcgccattgtgctgctgctcatcgtgctcgtacaggtgatccagtgggtgggcgaccgcatcgccgtcagggtcacccactgagtccgtacgtccatggcgcgcatccgcgaaagtcgagtgcgcgcttaatgtgcttatggagaagtcgcttgctgtgcaacgcattcacaatccgcacgcaacactgctgggttacgctcgcactgtccgtcaccttccgtccatgccatgcgcggtatgggcagatgtgcctgatggctctggacgcaagggaaaacgcgcggaacaaggaacgagaacgaggagagaaggcatggccattcatttcgccaaggtggcatcgcagattccgccgaacgtgttcgagcgcatggaccggaaggtgctcgccgcacggggtcggggcgtcgatgtgatcgatctgtcgaaaggcaatcccgacggtttccccgaggagttcattcgcgaggtgacccgtgccgccgtggacgatccgctcaatgcacgctacacgccgttcgacggcaagccggcgttcctcgaggcggccgcgaactggtatcgcaatgtgcatggcgtcgagcttgatgcgaaccgcgggctgttcgcggtggaaggtgccgtggatggcctggccgacctgttcagcatactgctcgacgagggcgacgcggtggcgttcgccgacccgtactacccctcctaccattgcatggccaatatgcggggcgcgcatgaggtgctgcttcccgcgaaggccgagttgggttggctgccggacctcgatgcggtgcctgcttcggtgtgggatggcgtgaggctgctcgtgctcaattacccgaacaatcccaccggcgcgcaggcgccgttggcgttcttcgaacaggccgtgaaactcgccgtggaacatgacttcgtggtcgtgcacgatttcgcctacgccggcttgggggtggaggagcagcagcacagtctgctcgaggtcgtggcccatacgccggccgggtcgccggagcgggagtgcacggtggagatctgctcgctctcgaagatgtatgcgatggcgggatggcgtgccggattcatcgccggtagcgaacgcattcttgacgtggcgaagaatttccactatcaaatgggttctatgattacttcgttcgtgcaggatgccggtgtggccgcgttgaacagcgaccagacctgcgtcggaaggcaggccgcgcattatgcgggtcgccgcgccatcgtggccgatggcctgcgcgaactcgggtacgatctgttcgattcgcagggcggactgtatgtgtggatgcatgcccctgccggcaggagcggcgaggaggtcgccgacgacctgctcgacaaggcgggcgtggcggtgctacccggcacctgcttcggcaacgtgggcgcacagtatgtgcgcctgagcctgctgcagcccgatgagcgcctggccgaggcggtcaagcgcatcggcacctgttgttgttgattgtcgcattccaattcgaatgccgtatggcattcgtcaatctcatcatgcaatctcagtatgtgagtggcgtggcgcacgcgtaacgtgactcatacacgcttggcgtggcgcacggcgcagccacagccaacgaatacagcacagacagcagcaaagggaggcccatacatgttcgattgggcattcgtggccaaatatgccccgttcttcgtgaacggcgcgtggatgaccctgttcatctccgtgtttggcattgcgctcgcgatactcaccggcatcatctgcgcggccatagagaccgcgcgaatcccggtgctcaggcagatcaccaccgtctacatcgaggtcagccgcaacacgccattgctggtgcagctgtacttcctctacttcggtttgccgaagatgggcttcgtctggtccgcggagctctgcgcgatcgtgggactggggttcctcggtggctcctacatggcggaatcgatgcgcgccggactgcaatccgtgccgcagatccagcgcgagaatgcgtacatgctcggcttcaacacctggcagacgctcacgcgggtgatcgtgccgcaggcggtgagcatatccacaccgggcattgtggcgaatgtgatcttcctcatcaaggaatcgtcggtggtctcggccatcgcactcgccgacgtcatgtacatggcgaaggacctcatgggcatgtattacaacacttacgaggcgctgttcatgctcatcgtgacctatctgatcattctgctgccgatctccattctcggcacttggcttgagaggaggttcgactatgcaaggcgctaacatcctgctcgaaccgggcgtgttcccccgcctgctgcagggcctgtgggtgacgatctggattgccgcggtctccgtcgggttgagcattccgttgggattgttgtgcggctggctgatgacgctgcgcaacccggtcatccgcttcgtcatgcgtgtgtatctcgacttcattcgcatcatgcctcagttggcgttgctgttcatcgcgttctacggcattgcgagaatgtcgaactggaatatggatgccacggcatcatgcgtgttcgtgttcgtgctgtggggcggtgccgagctcggcgatctcgtacgtggggcgctgcaatcgattccgcagattcaatacgagacctcctacatgctgggattgagtaactggcaggcattcgtccatgtgattctgccgcaggcggttcgtcgcctcctgcctggtgcggtgaatctttcgacccgcattgtgaagacgacgtcgcttgccgtgctgctcggcgtggtcgaggtgatcaaggtgggccagcagatcattgacgcgaaccgattccagtacccgaccggaacactgtgggtgtacggcgtgatcttcctgatgtacttcatagtgtgctggccgttgtcgttggtggcgcacgcactcgaaaagaggtgggcaaatgactgagcgtacagattccgttgccacggcaccggccgacgtgccggcactgcaggtgaccgacctgctcaagcactacgcggacgccgatcggaacgtgttcgacggcatctcgttctcggtgccgaagggcaaggtgctggtgattgtgggaccgtcgggctccggcaaatccacgctgctgcgtgccatcgccggtctggagccgattcagggcggcacaatcgcactggacggccaggtgatcgaaacgggcaagcccgggaacgagaaatccggccgtgcgaagcggcccgagtcgctgcgcacgaagttcggcatggtgttccaaagctacgagctgttcccgaacaaggacgtgctcggcaacatcaccatggcgccgatgctcgtgcagaagcgaaagaaggctgaagtagagcgggaggcgatggaactgctcgatcgcgtgcatctcgccgaccgcgcgcaggccaagccgcatgagctttccggtggccagcgccagcgtgtggcgatctgccgcgcgttgattctgcaccccgagattctgctgctcgacgagatcaccgccgcactcgaccccgagatggtgcatgaagtgctcgaggtggtcgtcgaactggccgatgccgggcagacgatgctcatcgtcacgcatgagatgcagttcgcgcgtgccatcgccgaccgggtgattctgctcgccgacgggcagatcgcagaccgctccacgaatgccgagcagttcttcaccgatccgcagaccgagcgcgccaaggaattcctgcattccttcgacttcgaacgccatcgcagcgcacaggcccatgagcgccttgaagcgttcgacgaggatggcacgggagacggccagtctgcacacaattagatttccataaggaaagagacaaggaaaaaccgggcacgaaagggaaatatgagctcacttttcaaacagttgggtaaggcagtcgcggcggcgggagccgcagtgatgatgatcaccgctgtggcggcctgcggtccgtccgcttcgacgccgagcgaggcgggatccgcctccggcaatacgcagaacagcacgaacgccaaggcgcgcacgctcgacgagatcaagaagtcgggcgagctgcgtgtggcggtgttctccgacaaggcaccgttcggctatgtggacaaagatggcaagtacgccggctacgacatcgagttcgcccaggcgctcgccgacggcctcggagtgaagcccgtgtacacgtcggtcgatccggcggcgcgtgtggacgtgctcgcgtcgaacaaggtggacgtcacgctcgcgaacttcaccgagaccccggaacgcgccgagaaggtcgacttctcgaagccgtacatgaaggtcgcgctcggcattgtggcaccggatgcggcgccgatcaaggacgtgaaggacctcaacggcaagacgctgatcgtggccaagggcacgaccgccgaaacctacttcgagaagaatcaccccgaaatcaagctgcagaagtacgaccagtacgccgacgcctacaacgcgctgctcgacggccgcggcgacgcgatgagcaccgacaacaccgaggtgctcgcatgggccaaggccaataagggctaccgtgtcgacgtgaccgagatcggcgacgtcgacgtgatcgccgccgcggtgcagaagggcaacaaggagctgctcgactacatcaacgacgagatcgtgaagctcggcaaggagaacttcttccacaaggacttcgagaagacgctcaagccggtgtacggcgatgaggtcaatccggacgacatcgtggtggaatccggcgtgatcgagaaatgagtcggtattcgactcgcgatcacatcgtgtgatcgcgggtgaacagggcgggcgccttccgtacaggaggcgcccgttttgtatgcggaccgttcatctcagctcgtggaccaaacatgtcgtaaaaattccatctcccgaaaacgcaatgggaggggaatccgcggttcgatacggtgagaggaggtgcccgaatgaataccgggtacgggacacagaaagagggagaacatgagcccatcgcttatcggaatcggcgtcattgcattggtggtgatcgtgctgctgtgcatggcgatctatgtggtgccgcaacagcaggcgtacattatcgaacgattcggcaaattccgctccgtgagattcgcaggcatccatctgctgattccgttcgtcgaccgcatcgcgatgaagacgaatatgcgcgtctcgcagctcaatgtgaaactggagacgaagacgctcgacaacgtgttcgtcacgatcgtggcgagcacgcagtaccgcgtgaatccggacaacgtggcgaaggcctactatgagctccgtgatccgcaaggtcagctgcgttcctatatggaagacgcactgcgttcggccattccgatgctcacgctcgacgacgccttcgccaggaaggattccgtggcggccgacgtgcagcagacggtgggttccgaaatggcgcgcttcggcttcaccgtggtgaagacgctgatcacggccatcgacccgagccccgcggtgaaatcggccatggactcgatcaacgcggcccagcgcgaaaaggaggcgactcgccagcatgccgaggccatgcgcatccagatcgagacccaggcggccgctgaagcagagaaggtgcgcctgcagggcgagggccaggcgaattaccgccgcgagatcgccgatggcattgtggaccagatcaagagcctgcaggaagtcggcatggacattggcgcggtgaacaacgtggtgctgttcaaccagtatctcgatgtgctgcgctcgctctcggaatcgaagaacgcgaagacgctggtgatgccggcggccacgccaggcggctattcggagctgttcgaccagatgacgcaggcgatgctcaccacgcaggaatccagtccacagaactgatctcatacgcgcaaatgccggggccgtggaaacttccacggccccggcatttgcgcatgtgtggtccggacgatatcaggagtcgagaaactcgcgaatccgcgctgcctgggcgtagcctgcgcggtacatgcgctcaaggccttcgaaggtcttcgacatggtcgagagcccgtagaggctttccggggagaggatgagcaccttgccctcctgctcgtaccgcctggcgagcgcgacctcgtcgttgtacgtgcggtagcggttgagcagacgttcggctgcggcgggatgatgccgtttgagaatgcgtgccggcgcgacgtccctctgctgttcgcgggccacgtccaccgggcgtgtgagcacgacgacgatgcggtcgcaaccgtcgtcaatggcccgctgcaccggaatcgggtccgcgatgccaccgtcgaagtacgggacgtcgtcgatcaccaccggctggcatgccaccggtaccgcggaactcgccttgagtatcgtgtagtcgtcctgacgcatgtccgatttgtcgaagtagcgcgacgagccgtcctcgccgtttgccgccacgacggtgaaggtcgccggattgtcgctgaacgcggcgtaatccaacgggttctcgccgtcgctgttactcagcgtgccatacacgtagtcgagatcgcagaagttgcgtttcgtgatgtagttctccatgctcgcatattccttgcggaacgcgtactgcgtgtagaacgtgtgcgcgcggccctgctgccgcgccagatatgatgccagattcgcagaccccgccgagatgccgtagcagtggtcgaaaccgacgtcctcctcgaggcagcggtcttcgacgccggccccgaagatggcgcggaaaccgccgccgacgtcaatgattccggtggtgtgtgcggtgtgggtcatacgggtctcctcatctgatctgcttgggtcttacgggaatggctgcagactacctctccagcagttgctgcgcgagttcggctatacgctcgcccgggtcggaattgcgcaagataacgccgccgtcctgttcctcgggggcgagtttgccgagggattcgagcacgacctccagatggcgtgcagtgccctcgttgccatcgacgatcgcgacgttgttcggcagcaactcgcggaaatagtcccggtagaacacgaaatgcgtgcaaccgagcaccaccgagtcggtgtgggcgaggtcgtactggtcgaaatagtcgtgcagcgtgcgcatgacgaggtcgtggtcgtcgagctctccacgctccacgatttcgacgagacgcgggcacggctgcttatgaatggtgtgtgcatcctcgaaacgatgcatgagcgccgcgaacttccgctcgcgcaatgtgagcggggtggcggcgacgatgacgctctggcgttcgccatgcccgcggtcgcaggccaccttgagcgccggttccatgccgatgatcggaatgtcatagtgctcccgcagttcctgcacggcgctcgacgtggctgtgttgcaggcgatgacgaccgccttggcaccctgttcgacgaaatcctcgacaatgcggaacgagaggtcgcgcacctgctcgggagtcttcgtgccgtatggggcgttcgccgagtcgccgaaatagaggattcgctcatgaggcagatccgttcgaatctgcctgaccacggagatgccgccgagtccggaatcgaacacgcctaccggtgcgctggaggtcatgggagtctctttcctgcatgcgggtgatattgcaagtctccagtctacagacctgcgcgtattccccgcttcgctacacgtatatgcacatctcagcttcggttgcggtagagtgggcggtatgagtttgccagaacatatgatcaaggcgcagggcaccggcaacgatttcgtgatgtatgccgaccgcagtggggaacacgcgccacagaagcaggacatcatccaattgtgcgaccgtcatttcggcatcggcgccgacggcctgatccgcatcacccgcccggggcatgtggccgatctggacggacacgacgcccagaagatgcgcaaggagggcgtggagtggttcatggactaccgcaacgccgacggcacgcttgccgagatgtgcggcaacggcacgcgtgccaccgcgcagttcctcgtgcagcagggaatgctggagctcgaggagggcgacgcgttcaagctcggcacgcgcgccggagtcaagcgcatcacgcgcatgccggacaaccccgaattggggcggcaattatggcgcgtggacatgggctcgtggtcgatgggggcggaggacgaatacaccgtcacgattccgggtgacaccggttcgggcaagggaacgttcgtcgacatgggcaacccgcatgtggtgaccgtggtggaggacgcctattcgacgctgccggtattgggcgaactcgatctgacccgtgccccccaggtgagtccggaactgccgaacgggcagaatgtggagttcgcgcgcatcgacaacctcgacaccgagcgtgacctgggcgacgcctcaatgcgcgtatacgaacgcggctgcggcgagacgatggcatgcggtaccggcttgtgtgcaacggcaatcgtgttgcgtgcgaagacgcagattgaccactggcgcattcgcattcccggcggcatcgtgcgcgtcgatgtgaccgatgactcggtgatgctcaccggcgccgccgcgctcaccgccgagttcaggctcctgcagtaggccggcgcacgacaccccaccatctcagcggaacagcatcgcgccgtctttgacgaggatcagcgtgatgagcgccacgatccacaccgcatcgaccatgagatcgatgttgaggcggtagtaggtgcgcagtgaggacgcatgcggcggcagatgctgcacggtcacggtggcgtgcgagaccgccatgaactggatggtcgtggcgaacatgagcaccaggcaccatgggcacagtgcgttgatgacgaacaacgactgcgaggtgagccagtacgagtatgccagtgcggccaacgagccgagccaggtgcaggttgcgaaccatttcggcatggtcatgcgggccatgccgatcacggcgatggtgacgaacaccgactccgcggcgatgccgaagaacgcgttcgggaagctcagctcgccgaatttgacgatctccgattgccaagcctgtgccacggtggaacaggagagcacggcgttcacgtcacatccaagcgactgacccgggtgcctggccatctgcagcgtctccgccgacagcacgaaggagaccagcaaagccacgcccgaggcgagcagcatgaccagataggtccatgtggccccgttgcgccaaccatgcggtttaaggtcggtgaaagtcgtcgatgactgtggtggtgatggctgttccgggtggcgttccatatgatcctccggtctgcgcgggcgttcgttcatgccgccgggcgaatacgttctggcgttcacgataccgtatgcaacctgaacggcggggcacaagtgcgcattctgggagaaaataccgggcagaatctcaaaatctgcacatgtggcggttacattcgtttacgatggaaccatgagtgaatatgtcatgccaacgagaccgccgcaggagggctgggatctgcattgccataccgtgttctcggatggcacgcgcacgccgcgtgaaatggttcaggaggcgaagtcactcggcttgcatggtgtggcaatcgccgaccacgatacgaccgccggatgggaggaggccgggcaggcgtcacacgacctccatctgccgctgatgcgcggtacggaaatcaccgcgcaggatggcaatgtctccgtgcacatgctcgcgtacctgtacgatccacgcaacaggcatatatgcgacctgttcgagaagacacggcgctcgcgtgtggagcgcacgaagaagatggtcgcactgcttgccaaggattatccgatttcctggcagagcgtgctcgaacagaccaaggagggctcgcgcacgacaatcggacgcccgcacatcgccgacgcgctcgtggccgccggcgtgtacgcgaaccgcaacgaggcgttcgccgatgcggtgagcacgcacagcaaatactacatacccacgccgtcgccatccacaagcgaggtggtgcgtgcggtggagggtgccggcggtgtctcggtgatcgcacatgcggctgatccgagccgcaatcgcgtgctgctttccaacgaacagattgcgcgcctcgccgatgaggggcttgacggtcttgaggtatggcatcgcggtaatcccgaggaccagcgtgcgcgcctgcttgcattggcacagcggtatcacctgctcgtcaccggaggctcggactggcatggggcgggcaagccgaacgcgcttggcgagaatctcaccgatgacgccaccgtggcagagatcgtacggcgcggtgcgattccgctgtgtcgttgagcaccgcctcctcttggcttgaaatgtgtgggccggacggttcgggaggaaccgtccggcccacacattgttcatgccgaagcccgcgaatcagccgaggttgccgaaaccgacggcgtgacgctgttcggagccgacgatcacgtatccgagtgagtccgccggcacgatgatgcggcgatccttgttgtcggtgagcacgatcggcttgtgttcctccaatgcacggtcgatggtggcggtgacggtctccgcggcctcgtcggtggtgaaggtgacggtgcgggcgacgttctgaatgccgatttcaatgtccatttcgagtcctttcgatatgctgcggttgccttccgctgcaaacagctacgttatatacaatcgcattgctcgccagttatttcagattcccagcggccgaacgcgaatgggttgccctcagccgttcgtacggtcgaggtcgtcggacgacccgtcggtcgagacggcctgcgtacccgcccccgaatccggcccctgcgtgccctccagaccggcgcgtgcgtcgcgcatcgcgcgttcctcacgctcgagcaacggaatcaccgtcgtctcggcatcggagcggcttgcggccacggcggaggcggtggaatcggtgcggtcgccgattgtatcgtcatcggcatagtggaagtcctcttcgcgtacgatctgcgtgccgcgcgaggagctgtcgttgatgcctatgatcacggtttcgctggaaagcacaggcgaatcgttcgtcgaatcgtccacggcagccaccggatgcgagttcgtgcggtcatccatgacctgcgaataggagcgcgaaccggtgacatcggtctcgttcgtggagtcatccgggaagccggcagaactcgccggagcggccgtgcgggaatcctcacgcaacagcgtgttcacggtgacggtgctcggtgcgttgcctgaggtcgcggcggcatcggaggccgggcgggcggtatgcgcggcgcgggcggagacgccgagtttgtgggcgagcctgtccacctgtgccttgaactccatgatgcggtcgttgtcgccggcattgagagccttgatgaaatcgcccacctgctccatctgcacccacagattcgcacgcagcatgatcaggtcgtcgagtcgattgcccaacacccggccatacgcggtgatcacggcgttgcggtgcgtctcgtcgagtttggcgaacacccatgccagatcgcgggccggatcgttgatctgcatatcctgccagttcgtgatcgcggtaatcgaggagcctgaatagatcagatcgccgtcggagaaaccgccgtgcaccgggcgtgtggagaacgaccacagtccctcggtctccatgatgccaccccagcggctcgtgatttcctggggaacatggcctgcctggcgcaaccgtttgatccacgcggtgagctgcgcatgaatctggccggtggtgaacaccgggtagtgtgcgtctgtgatgaaattctggcgcaggcgatgaatcgcaccaagcgcggtgccgaaactcgagcagtcgtctatggtcagcaactcaagggagcgcgcgacgccgtccggatgcgtcgtgatgagcacagatgcgtcctccgggccctccttgcctgcatggaatgcgagtacatgctcggtaccgaagccgagcccggcgaattcacgagaacggtcgaccacggcagcggcgcgcccacgggcatggagccgcttcttgccacgcgggtcgtatgccgcgtacacattgaacagacgcccgcgcatatcctgcaccacggcctgctcaatgccgaccgcacggtcggtgtcgttatcctgctcgctatcgcgaacccccgccacggacacgttcggcatcgtggcagaagccaatgccgccaacttcagattgcttcgctcactcacagtgcaatcatggcatgcacacggtacaaaatccaatgattgcaacgctttacgttcgttgtgaacgggccgtgaaccgtgggcatcgtcgttcctccacgcacctgctacaactttcgccgctcccgtggcacaatggcggcatgagcgaaacagcacagccgaatgcgggcacagacaacggggccccgaccatcgcacacagcgaagtcgaaatgggcacgacctcacctgagcgcatactcgccacgctcgatgacgcccaacgctcggccgcgctggcagtggacggcccggtgcgcatcatcgcggtcgccggcgccggcaagacgcgaacaatcacgcggcgtatcgcgtacgcatgcgcgagcggggtatgggatcccacccgggtgctcgcagtgacgttctcggtgaaggcggccaatgagatgcgcgagcgtctggacgcattgcaggtgccgcgtggagtgcgcgcatccacgttccattcggccgcattgcgtcagatgcgcgaggtgtggcccgacatctgcgaagggcctttccccgacgtcaccgaagacaaaagcgcgcttgtggcccaggcactgtatcgcttcaacggaatcaggccgaaggagcagccgaaacagagcgtgtacgaggtgggtgccgaaatcgattggtgcaaggtctcgctgatcaccgcgaagaactatgcgcgcgtgtgcgctgcgacgcaccgcacaccgccggccggtctcgaaccgggccagttcgccaccgtctacgagcagtacgaggcggagaagaacagtcggttcgagatcgatttcaacgacatcctgctgttggcatgccacgtgctcgacgccttccccgacgtcgccaagcgaatccgcaggcagatcggttggctcaccgtcgacgaataccaagacgtctcgccgttgcaacacctgctcatgacgcgctggctgggaagcaaccgcaacatctgcgtagtcggcgatcctgcgcagaccatctattcattcgcgggcgccaccagctactatctcgagcatttcggcaaggagttcgctccgctcaccgctgatatcgcgttgaaccgcgactaccgatccgtttcacccattgtcggctacgcgaaccgggtgcttggcggctccgcgcaacgacaggactacatcaggctcgaatctgggcgcggaaccggctcgcgcgtgatgagccgcatctacgagaccgacgcagccgaggcccaggcggtcgcacggcagatctcgcgcattctcgcgcagggaggcaacgcgagcgactgcgcggtgctcacgcgcgtgggcggccagcagacccttgtcgcgcaggcgttgaaacaggcgaacataccctaccggctgcgcaggaacatgaactggcagtcgtccgcgctcgccggcacggcacggcaggagaccgcggagacatcgaatgccggggtggagcagcttggcgtggagaaggggcgcgtgacaatctcgacgatccatgcggccaagggcctcgaatacaagcatgtgttcgtgataggcctgtcggaggggctattgccctacaagccgcaaagcgatgacggcgatgtggaggaggaacggcgtgtgctgtacgtggcgctgacccgtgcggaggacaccctccacctgtcgttcgccaaacgatcggattcgcagaccacctatgtgcgacggctgagccgattcctgcagtaagtgcgtgaattcggcaacaccaatgcgaacggggccatccacttcaaatggaaggccccgttcatgtatgaggttggattttgggttattgctcaagtgtaccgctatcagggtcttcactggcactgtcaccggaatctccggatccgtgctggtccccagagtcgccgtcatcggcatcttctgtggattcgccctcaccggtgccgttctcggattcgtcgagcagtttgctcagctcggcgtcccaatcgatgtcgtcgccgtgtttggcttccgtcgcatctgcctcggaatccgcatccataccgtctgcattgccttccggctcgagtgccggcagcaggtcgggatgcgaccacattgcgtcacgcgcctcgatgccctgctcggcggtgatgcgctcccacagctgggccgcctcgcgcatgcgcttggggcgtagctgcaggccgatgagattctcgaacgtccgttccgcagggccgccgacggcacgctcgcggcgcatcatctcgcgcaactgctcgatgtggggcagatgcgccatgccggcgcgccacagcacacagtcgacccatccctccacgagcgcgagcagcgtctcaagcgagcgcatcgcgtctttctgctcgggagtgtcttcacccatgcccacattcgtgagattgagcgcactcgacagcgaatcggggtcgagcccctcgacgtcgcgcaactcgtcctccatcgcatccagatcgatggcgatgccgcgggcatacttgcccaacagcgcctcgaaccttggcatgagccacggcacggtggcgaagagacgtgcataggcctcctcgtggagtgccaggaacgtggtcacctcatcgacaccgatctccaacgacttcgcgtattcctccacgttctgcatgatgaggccaccagccttgttcttcagcaaggcaagaccctggtcgaaggaaccacgcacctcatgggagagcgcaccggctgcattgcccagctgcatgctgaacgtcgccttcgccaactgcttcatcagcttctttgggtcgcgcatgctctccggaatcggaatcgggatgggcccggcgaacatgccggtgatctcgcctccgaactggtcgccaagacgctcgttgatcacggcgttcatggcgtcggccattgacgaggcgaccggagaggcgaacttggcccactgctcgatggtgccgttgagccagctggaacgggtgagcacactcgcctcgccgtccaccgggttgaattcggtggcggtgtcgagccatagattcgcctcgctcatcgcgcggcgcatcgtctcgccttcgcctgccgtgaccacctgctcgctgtcttcgccgttgacatattgcccggcaatcgttttcgcaatgttcacgtcgatggccgcgttctcgtcggccgtcggagattgtgctgtgctctgggcggcgtcagtgggggcgcccgcattggcgctatggaagccggccggattggttcccgccgcattgcccggttcacccataccgaacatggagcccatcggagtgttgccacccatgaacatctgcatcatctgcttcatctgttccggactcggaagagatgaggaatcctggctcatcagctgctcgcgcagcgcatcgggcagcatcgacagctgctggaatgcctgttcgccctgtaccggtccaaagcattcgataagccattgacggatcgcgtcttcactcatggcagatcctcccctgtatgtccataaagtccgtatctagcatttctactcacaatacgggctaaatattccgaatgcatcatggctgtggatcgtagtggagcatggcggccaagacctgcccatactatggaggcatgtcttcgttgaacccacccgagtcaatctcgcaagtcgattccgatgtccccggaacgcccggccgtggtcatggcgtgttccgtcgtcttcgcgcgcgctggcacaatcggcccaaacgctatttcataggcctgttcaccttcctgctcgcgttgtgcctcatgcttgcgccgagcccgtacgtggtggagagccccggccccaccgagaacgtgctcggcaaggccgatggcaaggaggtgatctccgtgagcaatgcgaccacttaccccgataggggcgaactgttgctcaccacggtgaatgcaagcggcgtgcccggctacccgatctcgaacatctgggctctgatcggttggcttgaccctcatatgaacgtgctgccgagtgaggcggtgttcccggtggggcagagcagcgaggagtatgatcaggaagccaaggcggatatggactcgtcaatggaggcggccacagctgccggtctggcctatgcgaagaggctgggagccaaggtgtccgatgccgacgtctcaatgcacatcgaagacattggaggtccctccgccggcatgatgtacgcgctcggtctggtggacaaactcacgccggagaatgagacgaatggcgtcaccgtggccggcaccggcaccatcgacaagaccggcaaggtgggggctattggcggcatcgatctgaaaatgatcggtgccctgcaggatggcgcgacatggttccttgcccccgaggagaattgtgatgaggtggtggggcatgtgccgaacggcttgcgcgatgtgaaggtgtcgacgcttgaagaggcctataccgcactcgtcaaaataggcaagggcgacgcggattcgctgccgcattgcacggtgagacgggccgcggaccataatatggccggagaatgatcggctgagtggagagggatgcccggcaagtgtccgaacagtcacgattcattcgcgcatggcttgtaaacaggcctgttccatggctttggtatatttacgagcgtgaatcaaacagcatcagacaacgctgaggagttcggcttccgccaaggggacctggtccaggaatggctctgggacgatgacgtggatgactcgatccgagaaaaaatcgaaaaactcaccaatgaggatctggtcgacgaggaatatgattccgcggtcgacggggcgattatttggtggcgcgatggcgacgacgaagatgaactgtcggacacaatcgtagatgcttacgcagtgctgggcgacgacggcccactgtgggtgctcacccccaaaccgggccgtgaaggggctccatcaccgagtacggtgcagaacgcggcgaaaaccgcaggtatgaatgcggcgactccgctcaccgtgagcgatgattggaacggtattctgctgcgtgcgttcggcaaaggcagatgaacggctgactccttggaatgaatccgaattccatggagtatccatgcacagtcatcaaaggcccggcatgtgccgggcctttgcgtatgcgacgacgggattcagtcacaaggtggacgacgctagagcaggcaggcaaccagcaacagcaatgccgcacagacgaatacaatgagcgagtcgcgtgtgcgcggcagcttgccatgtgcaatggtgatcgccacacccatgccacctgcgacggcgaagagcgcgaagaccacccagcggatcgtctcgccggatgggtcgatcacatggaacagggtgaggaacatcggcacgagaatcagcgcggcaagcgacatgaacacgattgcgagcacacggtccgccgtgcgcagcgaacggtcatgatgctgcgtgcgcttcaatgagtcgacctcggcagtgagctctttgattcggcggtcgagttcgacatcgcaccatttggattcgcggtcgagacgcgcgatctgattctccaggtcgtcaatccgctcatcgttctcgttcggtttgcgcacaaaggaggggatcagatgcggcagtgaggagagttggttggaaacgctttcgaaaatactggtcatactgccgagtataggaatctagagaagcgccggaggcgatatggcttacggagaagaaacgtgggcgataagggactcgaacccctgacatccaccgtgtaaaggtggcgctctaaccaactgagctaatcgcccgcaacagaccactatacaggaggggtggaagagtcgtggcagatgcgacgactcggatgcggcatgtacgccaaccgactagaatcgtcaaagacaggcggtcgcgatggcggcatacgcaaccgcgagcgtaatgggtctgtgagcgaacgtattcttgagctaggtttgtagttcgtcgggctgcatggcatgcccagacagcccacggcacacagtatggaaggaacgtcgatggcgcaggaacaggaatcgagcagcacatccaccagcattccccgcgttggaaagcattccagggggtatgatccacgtcaggtggatgccttcgtggcccaggcccatcgactctatgacgaaggcgatccctcgctcaccttggccggcattcagaatgcctcgttcgccatggtgaagggcgggtatgtgccggcgaatgtggatgccatgctcgaccgtctgaaaagcgcgttgtgtgacaagcagacgcttgccgagatcagcgagctcgggcgggtggcctggaaagcgcagatggaggagtcgctgcgcgaattgcagcgccatgcagaccgtgaccacggtgcccgattcgcctccggtcagcacaagatgctctcatacaagcgcaaacaggtcgaccaactcatcgatgacatcatggacaaggcggcctatgagctgtccgaggtgacaaccgacggaacacatccggcggtgggcaacgacccctacccgaatctcaatgcaaaggccatagagaatgcggcattcaccgtggtgaaagggccgcgcggctatgaccagcgacaggtggactattatctggcaacctgtgcggatctgctcggccggctggaatcctaccagcgcctcaatgagaacggcagcatcccggcatccggcacggtggaacgcccggcatcggcggcaccggtgaacggagtcaagccattgttcgccaatgtgccgcagacgcagggagatgagccggagaatccggcgacatccccaagcatcgcagccgacggctccaatgcgccggttcaggcaaccatggggcaggcggattccacgcaaggcagtttcgacgaactccatgctcaggaggaggcgattttcaacgcaggcaccgctgccccatcgccggtgattccgccggccaccatcagccagatgcctgccgcgccggtcgcggcagctgccttgccgttctccgaggactccgcgccaaccgagacgattgccccggtggtggaggatcacgacacgccatccgcaagcacattgggtccgggaacgcatagtgcctcgcatgcctccctttcgtccatacagccgatcacaccggcaccgcggaccattccgtcgtatgaaagggcggtggccgcacagacgccatccactcccgccacccagaccccgagcgattcgaatgcatcggatgacaaagccgacaatgccgagacggttgcaccgacacagatgaaaccgttcgtcgccgagcagccacagacctccgaaacgttgtcgtcgttggcatcgatggtgcatgagacctcgagcattccgcagagctcaagctccttggacgaggccaagtcaatcttcgacacgctgtcggtgccgaagctcaccagcgtatcgattcccgacctgccaatgccgtcatcggcccacacctcaacggaatccactgatcagtcgcagaattcggtggaaacgaacgacgacgccgtgcgacgctatattcgtgagagccagatgaacatcgacatccccgatcttgcgttccccgatgcgccgtcgggacgtgactcggccccgaggcagtgaatcagcgggcacatattcacacaaggattgaaatctgagggtagaacgctcaatggaagcagagcatcaacgagtcatcattctgggatccaccggttcaataggcacccaggcacttgacgtgatcaaccgccatagagatcggttcgaggtggccggtctggctgccggaggctcacatgtggagctgctggccgaacaggccgcctcgttccatgtaccgcttgtggtggtgtcgaacccgcaggccgaggagccgcttcggcaggcattggacgccaagggcgcccacgccacccagattcgcagtgggcaggacgaggtggtggcactggccggtgccggggcttccgtggtgctcaatggcatcaccggatccatagggctcgaaccgtcgattgccgcgttgcaggccgattcccagctcgccctggccaacaaggaatcggtggtggccggcggccacctcctgttcgatgcgcagacacgtgaacaccagatcaatccggtggattcggagcattcggccatttggcagagcctgcgcgcaggtacgcacgccgaggtctccaaactcatcgtcactgcctcgggcggcccgttccgtggttggacacgagagcagatggaatccgtcaccccgcagcaggcgctgaaccacccgacgtggaacatggggccggtggtcaccatcaactcctcgacgctcatgaacaaaggcctcgaagtgatcgaggcgagcagactgttcgacgtggccgccgacaacatcgaagtcaccgtgcacccgcaatccatcgtccactcgatggtcgaattctgcgatggcgccacgatcagccaggcatcgccgcccgacatgcggctgcctatcgccttgggactctccgccccggtgcgtctcgatgacgtggcacgcggatgcgactggacgaaagcctcggaatggacgttcgagcctctcgacaacgatgcgttcccggcggtgaatcttgcccggcaatgcttgaaagcctccgagaaacacactacggtgttgaatgcggccaacgagcaggcggtgcacgccttccttgacggcaggctggcctatctcgacattgtgccgagcgtggctgagacgatcgaacagatggatgcgcagctgagcgcgaatccgctgttcgaatcggtggccgaagtcgaggagctcgagagggaggcacgcgtgcgcgccaacgagatcatcgccgccaaaggatagtctttcgacatccgagcaggcgatagtctgcatacacaagacacaacacaccagacacagaacacgcgggatctggcgcgggcatgccgtgcagtaccgcagaaagagttccaaacaggtatgagtgagccaacgttccgtaagacaggtgaggcggcggtgagcgagagcccgctgcatgcgcgccgcaagtcacgccgcatcatggtggggccggtgccggtcggcgggggagcgccgatctccgtgcagtccatgaccaacacgaagacctccgatgtcggtgccacactccagcagatcgccgaactcacagcggcgggctgcgatattgtgcgcgtggcggtgccgaatcaggaggatgccgatgcgttgccgaagatcgtggcgaaatcgccgattccggtgatcgccgacatccacttccagagcaagtacgtgttcgaggcgatcgacgcaggttgcgcggcagtgcgcgtgaacccgggcaacattcgcaaattcgacgaggtgggtccgcagatctgcaaggcggccacagacgccggcatctcgctgcgcatcggggtcaacgccggttcgctcgacaaggagctctacgccaagtacggcggccccacgcctgaggcgctcgtggcgtccgccctcaaggaagcgcgcatgttcgaagatgtgggtttccacgacttcaagatctcggtcaagcaccacgacccggtcaccatggtggagacctaccgactgctcgcctccaaaggagactggccgctgcacctgggagtcaccgaggcagggccggcctggcagggcaccatcaagtcttgcgtggcattcggtgcgctgctcgccgaaggcatcggcgacacgattcgcgtctcgctctccgcgcctcctgtcgaggaggtgaaagtgggctgcaagatcctggaatacctcggtctgcgaccgcgcaagttcgacatcatcagctgcccgagctgcgggcgtgcgcaggtggatgtgatccagctcgcgaacgccgtcacggaggggctcaaaggcatcaccgcgccgattcgcgtagccgtgatgggctgcatagtcaacggtccgggcgaagcgcgggaggctgatctcggcgtggcgtccggcaatggcaagggacgcatcttcatcaagggagaggtggtcgagaccgtgccggaagacagaatcgtggagacgctgctcaaatacgcccatgagattgcagccaccatgggcgagaatgaggatggcatgggcaccggccccgtcgtcatgccgctgaccggcgagaatctgcaccggaagccaaccgcgtagaagctgtgcccgccgatgcgcggggaacaggaaaccgacaaatcgataggattcagcgtgtccaaagctcacgaaataccggagcggcagggcttcagccgcacacgtcggctcatgatcacactgccgatctttatcattctgctcggcgtgctcgtcatggcgtcgaactacacgcgactgccggcagacaacacgcccaccggacagacgttcgccacgctgtcgccgaacaccgaggtcaccttcgatacacgtgagcaactgcccaaacaaggtgcttacaaggtgcatgaatggcatcaggcaatcgatgcgaaacagccgagcaccggcgacgtgcagcgcatcaacatcaacttccgggagcccgaaggtgccggagacaatctgccggcggtgatgttcttccacggcgcgggctacggcacatgtgacaattcgttcggcgacatcgccacggcaatgtcatccgccggcttcgtcacagcggtcatagacaagccggtgtggaacacgaacgacacgacccgtgactatgagggctccgcggtgatctacgagcaggtcatcaacatgatgcgcggattcaggaacgtgaatccgaagggcgtgggactctatgcgacgtccgaaggcgcgtggattgcgtcatacgtagtgcaacgggacgagcaggtcgccttccaggtgctgctttcgcccatggtgttctccgcccggcacgcactcgcattcctcgccgtgcaggacttcgcccttgtcggcgcgaacgaggggtaccagtcgatagtgcgccgcgtgttctcgctcgacctgccggccctgggattgacgaacgccgacctcaacacatcggtgccggccgcctaccgcattcccaccctcgtggcctatggggcgaaggacgtgatgaccgcacaggtacagggcttcaaagacattctcgaacaggcacacaaagccggcaattacaatgtgacgctgcgcagctacccgattgcgaaccatgtgctgcgtttgggagacgaggcgatggagaacacgccgttcgccgacgattacatgcgcgacacggtgtcgtgggtggccggcacctcgcggggcctcacacagacaagcgagcccgttgcaggaacaccgctctaccagtcgatcgcagtgccgctggaactgcattcacgtcctgcgatgacgtggtatggcattgtggtgatggggctgaacctcatcatgatgctcgtatcggccgttctgctcgtggtcaccctcatacgcgcgatcatgcgtcgagtgcgccaccagtcacatggcatgggcatgcgcaaaccgtttgcacgcgcgctgagattcaccgcgataatgacggcggctgccggtctgctcttcctgggcggtttcgcggaagtggtgatcgccgtcgtgcaattggcgtggggcaaggctcccgattctagtgccggcatgatgtactggagctggcccgtcacccagttcgcctgcgttctcgtgctgtgggcatgggcgtcgatgatagagcgaatcattgagatctggtcgcagcggggactgttgcaatggcctatgaatcgcgacgcgtggcgtgcgctcgtgcacaacgacgatccgatcatcgcgaccagcagattcggccgcgtgttcttctggatcctcaccatcacgctgatctcgatgctgctgtgcttctccttctggggattgttcaggttctagggagccggctgcatggcattgtacagggacgaggccgtggtgctgcgcaccgccaagctcggcgaggccgatcgcatcatcacattgcttacccgcgaccacggcaaggtgcgtgcggtggcgaaaggcgtgcgtcgcacgaaatcgagattcggggcgcgcttggagccgttcatgcgcgtcgatctgctgctgggtgaggggcgcaccttcgacagcgtgcggcaggcggaatccataagtgcgtatgccggcggcatcacgggagattatgccacctacactgcggccagtgcgatgtgcgagaccgcggccgatctgctccccgccgagcacgagcccgcggcagcgcaataccgcctgctcatcgccgcattgggcgcattgagcaggcatctgcatgaccctcaggccattgcactgtcgtatattctgcgcgcaatgtcattggccggctggaccattcgcctcgactcgtgcgtggtgtgcggcagtcaggacgtggagttcttctcggcttcggcaggcggcgcaatgtgcccgaatgaccacacgccagatgccgtgcgcgtgccggtgcatgtgttcgaccagttgcgggcgctcgaacagggggattggccgcagctcgacatgctgcagacgcccgacccgcggtgcgagaacatcgttcgcgaatgggcgcaatactaccttgagcggccgattcgttctctgcgcttgctagattagaaccatggcttttgatgcagtggactacaaatccttgagcgtgccggccgcgccgttctccgaccccacgattatcccggatttcccgaagaacaaggttccccgtcatgtcggcgtgatcatggatggcaacggacgctgggcgcagcaacgcggtctcattcgcacggacggccatcaggccgccgaaccggtggtgttcgacacaatcgccggcgcaatcgaggccggcgtgcgctacttgagcctgtacacgttctccaccgagaattggaagcgctcgccgcaggaggtgcgcttcctcatggggttctcgcgtgacatcatccaccgccgcgtggcgcagatggacgaatggggcgttcgtgtacgctggtcggggcgcaggccgaagctgtggaaatccgtcatcgacgagctcgaggtggccatggagcgcaccaagcgcaacaaggtgatcgatgtcgtgttctgcatcaactacggcggccgtgccgaaatcgccgacgccgccgcagcaatcgcacgcgaggtgcgcgatggcaggatcaaaggcgaccgcgtcaccgagaagatgatctccgaacatctgtacaatcccgatattccggactgcgacctggtgatccgcacctccggcgagcagcgcacaagcaacttcctgccgtgggaggccgcctatgccgaactcgacttcgtgcccgagctgttcccggattgtggccgcgtagtgctgtggggttccatcgaccgctatattcaccgcgaccgtcgtttcggcggcgtcaagaaatagaacgcggctttcgcatgcccttgcaagcgaatcgggactgctattcggccacttgctctgtttcaatttggatctgccagtgagataaagcaagtggccgttacttgatttgtctcgctgggagtgcatgcccgggacaaagcaagcggctgttatttggtttattcgctcacacggtgggcaacgagaaatatgtgaatgttcagatgaccggcggggactcggtggagcagattgtcgacgccgaacgcgagcgcgaacggctgctgttgcgcagcggggtcgaccggatcgtccgcttccgtgttcgcgagacctatgattgcgcacggttcattcgcaagctgctcgaagccggagtgccattgcgcaagctttaggaatgtcaccgtagcgaggtgagcagattcgcaatgtcgcccgtgaaccgcgcgaggaaacgttcgcggtcgacgcccacggccacatgcgtggggcataaggaagcatcgatgaatccctgcggattgccgatggtgcggccgcgcacgccggtgccgtcgccgcttctcgtctccacacacatgggcaggtcgagcgtgccgacgagcgtcgcatcgagcgccaccgcagcggccaacggatcgtgcaacggcatgccggcggcgaagatcggctcgctggccgcgttcgcgcgaatggagaactccgcaatcgcagtgaggaaccgtgaggcctcggtatgcgccgcgttccaaggggtgatgtcggaggaacccagcaggcagcggtgggtgacgtcgagcccgaccatcgtcacgtccgcgccactgcgcagcacgcgatctgcggcttccggatcctggatcatgttcgtttcgcagacgaggtcgtagcaattcccttcctgcgtgagggtgccgcccatgaacacgatgcgcgcctgccgcaccgcctccgggtcgagtgtgagcgcggtgtcgatgtcggtgagcggcccggtgacgaggatcgtgaggtcggggccgaatgcgcgggcggcgtcaacgatcatgcgcgcaccggcggtggcctgcgagcagctctcctgcgggaattcgagtttctcgggagtgggggtgtgcgcagacccgctgggaatcgtgagttctggcatcgtgggcagatcggcgtgcttctcgcccacttggtaacctcctaccgagatcgcagtgccgcactcggtgaggttgcgaatctgtggtgcggtgagtgtgacgagtccattcgcgtcactggcgagcgtctcgccgggcgtagtcggcgtgaagtcggcattgtcgccgtcgccggtgctgacatctcccagaccatcgctgccgtggaattgcgcgcaaccggcgtcggcgatgaaatacggtgcccatgagggatgccttgcgccgtcgaacaccggtatatccgagcgcccgagcagactcagcacagcgcgggtgttgcgcgccgccggttgctcgagcacgttgccgtagctggcgctcacgccatgcagtcggacgttcggctgtgcgagaagcaacgccaatgcgagcgcgtcgtcgatgccggtgtccatgctcgccacgatgtggtgtatgtcggtctgtggattcgtcatgcccatgtctgtgtgccttgttgctgtgtgcggttgctgcgcgttgccgtcgtgccgctagttcgcctgtttcaggaattcgtcggtggcgaggtccttcgactgcggcgctgcgtgcaccacacgtccgtccgcgtccgtgtacgcgtcggattgcgcgaggaagtcgaagtacgcctgtgtgccttggtaatccgccaatccgaacgtctgcttgccggagatgatctgttcgcgatcgccccagtactgcccgtcgatgattgtcttcattgactcgcgcacgaattcagggtcgagattcgcctcgggtgcctccttgacgagaatgtcggcagcttcgtcgccatggtcatacgcatactcgtagccgcgttgcgtcgcctgcacgaagcgtttcacgaggtcgggattctgcgcgatgagtctgtcgctggtgatgatgccgattgaatccgcgttgccgggcacgccgtattccggttcggtgaagcagttgagtttcggtccgttgagcttggcctgcacgccttcccaggtggagtagaagccgccgaagtcggcgcggccggattcgagtgtctggaacgtggaggtgcccaccgtcaccttgtcgaagttgcctttgcccccgtcgtgctggatcatgcggcgcaccacggcgtcggactcgcttgatccgaaggtggcgaacgtcttgccgtcgaggtcgcgtggtcgtgtgatggatgcattcgaggccagcgcgcaccagatcgcgctcgtcttctgctgaatctgcatcacctgccggagttctgttcctttggtggagtaggtgctcacgttggtgagattggagagcgcgaaatccgcgacgccgttgttcaccgcctgctcggcgccggattgtgcgacggcgacgatgttcacgtcgagccctgcctgccggtagtaccctttgttcttcgccacatagacgccgatgtggttggtgtcgggcgcccacgacagcatgaatgtgaccttcgtgaggccgtcatcgccgccgttcgcgctgcttgtggaaccgcacgccgtgactgcgaatatggtgggcagggcggcgagcatggcgatgatgcgagtgagatgtcggtgaatatggcggggggatttcatatggtcactttcgaattggtgctcggatttgcagatttgtggattcactgggcgtccgggtcgtcgtcgtcggccggcgcgccgatggtgagtcgctcgacggcgtgcacggcgagcagcagcaagccggtcatgatgatgatcacgaaggtcgcggcgaagatgcgcggggtctggaaggaattgtaggcggcctgcagccagattcccagaccgctgcgtgcgccgaggtactcggcggtggcggcagtggcgaacacataggcggcgctcacgcgtacgccgccgaagatctggcgcgcggccacccgcagatccacatggaacagtgtccatgcgcgcgaggcgccacaggtcatcgccacgtcgtcatagaaggcggggacggcagccagtcctcgcatggtctgcacgacaatggggaagatggcgaacacggcgacaatgacgatcttgcccaccggttcgaatccgaaccagatgagaaacagcggggctattgagatgagcggcagcgtctgggccgcggtgagcagcgggaacagtgccgcatatgcggtacgggagcagtgtatgcctatgccgaggagcacgccgagcacgcaggctatggcgaatccgcacacgccctcgatgaacgtcatgcaggtggctggccagagggtgggccacgagatgatagccgagcggacgatctgcgtgggggaggagaccatcgtgacgggcggatgggccgcatcaacccagacctgccagatgagcagcagtgccacgacggtgacgacggtgggccaatgcctccacgcttgccggcgcgggcggtccgtgtgattgcgcaatgagctgtgaaaagccatggcaccttactttctgcgcatgtcgcgctgtgaggccgccggcttcaggcagcaaggtgaggagtctaccgccgaacgaccagaaaagttaactctgccatgcgtgtgcatggcgactgcaacagtataggccaccctgtgggcatgcgctcacgaagaacagcggcggggcacaagccgatgcctgtgccccgccgctggtacggtgctgcgtttgttcactcgagtccgatggacttgagcgagtgcatggtgagggtgtcgatgtgcgtggtgccggattcgctcacgagttcgacggcgcgtgcgccatcgccagggaacgagtacgagctcatcgcatgcttgccgccgtcgacgtagacctcgacgcatccgcggtcgatgaacacgcgcaagtcaagcgtatcggctgcgagctcggtgtcgctgagcttggccacccggtagcctttgtctccgttcgccacgttctgccggtcgatgacgacgccgccgatctgcgcgtcgaatacgattgccgtgtagtggccgtcgcttgtggcatgcacatgcagtccggcgcgttcggcggtggttttgttcagatcgagtctcatctcgatttccagggcgccgccgtcatcgtcgaggatcgtggaggtctggttcgtaccaaggtcgagcgagtcgaagcctatggtattctcgcgcagcccctccatttcgatggtgggggcggtgaccaggtcaccgtcatcgcccagcgtgatctcgcgggggagggtgaggttgccgcaccagccgtcctcctccatcgggatgggggcgacgaacgggctcatccagccgtacatgatctggcgcccttcggtgttgaacgactgtggtgcatagaagttatggccttcgtcccacaggcggaactcggtctccggcttgaagctctcgcctggcttccatgtgcccaccatgtagccggcattgttcacgttgcggttcatgaagccatttggcttggcacccatcgcggagaagccgatgacccatttctcgttgccccgcgcatcgcggatcgggaagaaatcggggcattcaagcatgaacacgttcggatccggatgctcgaacagcacccgatcgaagctccagtgcaccatgtcgctcgacgtgtacagccacatctggccacgatgctccttcgacgagacaccgaaggtcatataccaggtgtcaccggtcttccacaccttcgggtcgcggaagtggtggtccacctcgtcggtggggcagtcgatgatcatgccctccttcgtgaaggtcttcagttcgtcgtcgttcggcttggcgagcatctgcacctgccagtcgcctccggtgttgtccttgccgttggcccagcggtggccggtgtagaaaatccacggcttgccgtcgtcgccaatcacggcggaaccggagaacacaccgtggcgttcctgttcgaggcttggcgcgaaggcgatgggttcgcggtgccagtcgaccatgttgtcggaggagacgtggccccaatgcatcgggccccactgtgtgccgtggggatgcagctggtagaacacgtgccagcgtccgttgtagcggcacaggccgttcgggtcgttgatccacccgccattggaggcaatgtggaacttcgggtaccagcggtcgttgcgggtggtttccagtgccgacacgcctgcttcggcgagtgacagctgctcggcatggtccgagatcggcgtgagcacagggtcgagcgccgggtcgggggtcagaatgccgttggcgggaatattggtgggaagggttgccatcgtcgttgtcctttcggattcggctgtctgatttcgtttgcgtaatcggagacgttttcagtcgacatctgtctccttgtactcaggattgcaggatgtatacgggttcggaatccgggattgaggttgtattgcgtaaatagggacagttggaggctgccatttgtccctatttacgcaaatgaggggagggagaggagacgcagggatatgagagagattgacgggggggagaggtgcggatggggctttacatatcctcggaatccgcggagaggatcgcctcgtcggtggcgagcgacggcagcttcttcgaatcgcggatgaacggatcgccatccacctgctcgtcgtcgcgcttgatcacgaagaatccgtagacggtggcagcaagcacgatggcggagatcgtcaggaacgtcgtgcggtcgcccatgcggtcatgcagcatgccgagcggggtggagaagacgacctggccgatctgtgaggcaatctggaagccgaccatgtagagcgtcgcggagagcttcggattgaagtggagcgtgaagtagcggaacgccggcaggcagaacagcggaacttcaatggcgtggaacattttgacgatcgagatggacaccggatcgtggaagatgccgcacagcccgatgcgaaggaacatcaccgtggatccgagcagcaacgcgttgcgcacacctaccttgcgcatgatgatcggcacgacgcccatcatcgcggattcgcagaacacctgcaccgagttgagcgtgccgtagacggcgttgccggtggcctcattcgggaagagcgaggcgtagtaggtggggaacatctgctggtcgaatacggtgtagaacgtgttggtgagcagcatgaacacgatgagcacccacagcgtgggcatcttgagcacgccgagcatgtctttgatggtcgggttagttggcgcggcattcggatcggcggcttccttgagcgcttcgcgctgctcggccggataccaggtgaggtacacgatgagcatgcccacgccgaatgcggagccgagccagaagttgatcatcgggttgatgttgaacacgaagccggcgacaagcgccacaatggcatagccgaaggaaccccatgcgcgggattggccgtactcgaagttgaaacggcggctgtaccgttcggtcacggcctcgatgagcgagcagcctgccatgaagcccgcggagagaacgacggagcccacgagtgcggcggccatcatgttcgtcctcatcagcggcgcgtacacgaactgcacgaagggtccgacgagtgcggcgatcgccgagatgacgagcacaagacggcgcttgagtccgagattgtcctggatgaggccgtacccgaacatgaggatgagcgtggccagcgagttgatcgaatagatcgtgcccacttccgcgccgttgagtcccatcgagttgagccagcgctggaagaacgaccaccagatgccccaggagcagaagaacaggaagatgccggttgagctttgcaggtaggaggggttcctccacaccttcgtggttgttgccatgatgtgaacctcgttgtctgagcctaagctgcgttgtatatgacggctcccgcgcattgctccggtctgtgcaccgtgtgtccgtgttgtgcgcaggagggggcaggcctcgatgggtctgctaggggagcaccattcgcgtcgtctgtgtcagttgtggtgttccatatgttctcagaatagagtgtaaatcgattgacatcaaacgattgacttcttctccataaaaccaccatatttcctgaagccttaatgtcaatcgtttgacgaattctttgctgccgcagtgaccatgcgtcacgcggtcgtcggcgtgtcgcgcaccgatcccttctcgatcagcgtgcagtgcaccttcaccggcgatggcgtgtcaagcagaggcatcaccgcggtcgtatggggccaatcgccttcattgagcgggcggttctcgatcatcgacacgagcttgttcgcggcccagtagcccatctcgtagtggggcagttcgatggtggtgagttgcggctcgagtgtctcggcaaatacgcgatggttgtccacgccgaccaccgagatgtcgcgtccgacggccagtccatgtcgtgccgccgtctcgtatacataccaggcgcgtgcgtcgttgaagcagaagaatccgttgggctgctcggtgtcgaataacgcttccacggcacgtagtgccggcccgttgttgagcacgtcgcattgcagtcgttcgtcgaagcccctgccgtggtccatcagggcctgtcggtaaccggcgagcctgccggtctgtgccaccatgggttcggcgcatcccacatacgctatgcgggagcatccggcttcgatgagtctggtggtggcgtcatagccgatgcggaactcgtccggttcgatggacgggaagcgattggtctcctctgcggcgtcgacgagcaccagagggaacttggcgagtgatttgggcaccgtcatcacgcggttcgacatcgcggaatacaggaagccatccacaccgtagcgtttcagagcgcggatctcgctttccagggcctgttcggtgtctccgttcacggtgaggagcatgtagccaagcgagctcaaggcgtcctgtgcaccttggatcataccgcccgcatatggcgtggtggccacttcgacgctgatgaacccgatcatatacgtccggttggtgcgtagggagcgggccagcacattgggctggtaccccattcgctctgcggtttcgcgtatgcggttcgcaagctgcggattgatgcgccccgaatcacgcccattgagcacgagcgagaccgaggagacggagactccggccgcttgtgcgatttccttcatcgtcgtcatgattccaccttatacgtcctatgccgaatatgcacatgacataccgacggcacacccacatattccgtgccgcttaccgcttggtgagtatctcgtccacgagctgctgcttttcgctgatctgccctgagaagcccgggcgaatgtcgagcttgagcgtcacgccggtgcggtatccctgttcggcgagtttcaccgtggcgtcgcgcaccgctttgagcacatcgtcaaggtttccctcgatgttcgtgaacatggcgttcgtctcgttcggcaatccggattcgcggatcacctccaccgcttccgccacgtattcgctcagctcggcgccgacaccgctgggggcgatcgccactgccgccaccgtgttgatgatcggtttgccgtgctcgtccacgggcacttcctgccgcaccgcattgcgatcagggctgttcatgtgtcttctcctttgtcgcaggcgtgcgaccgggcatgtctgttcatcgctcagccacacagctatggaatttcagattgccttctgctcagtgcatcgcccaggcatggtccatcggaccgtgacctttgccgaggttaagattcgcgcgcagagctccgctcaggtatgccttggcgtcgcgtacggcgtcttcgaggtcctcgccttgggcgagatacgaggcaattgcggacgacagcgtgcagccggtgccgtgcgtgttgtcgttggcgatgcgttccccctcgaaccacgtgacggcaccggtcgggaatgcgagcacgtcgtcggcgtccttcacgccatggccgcctttgaccagcacgcaggtgccatagtccttggcgagttggacggccgcggtctccatgtcggcctggttgccgatcggcatctgggccagcacctgtgcctcaggaatattcggggtgatcaccgtggcaatcgggaagagactgctgatttcctcggcgattgtgtcgtccgcggcaagactcgacccacttgtggccaccatgaccgggtcgaccacgatgttcgtggcctggtggtccctgagtttgcgggcgacggttttcacagattcaacgcccacgatgacgccgatcttcacggcggtgggtcgaatatcgtcgaaaaccgaatcgatctgggcgcccacgatgctggggtccacggcggcgatggcctgcacgccggtcgtgttctgcgccgtgatgcccgccaccacgcattcgccgaatacatcattggcgagcatcgtcttgaggtcggcgggaatgccggcaccgccggaggagtcggttgtggcgatcgtgagcacggccggcagcttggttgcagcaggcttgcgtccggtgtaccggggcttctcgtcgccgcgaatggcggtccagtcatcgaccagacggcgagtggcctgctccgggtcggtggcgccggcaatggcggatacgacgaaccagccgtcggccttcgtcttggcgagcatgggaatgtcgtcggctttcacgccaccgcccacgatgagcggatacttgctcatcgtgcgcatttcgtcgatggaggagacgttcagcgtggtgatatcgccattttcgtcgacgatcatgctctcgggcttcgtggccgtcatgtgcagtgggccggctcctatgtagtcgatggtgccttcgggcagatggttggcttcgcgcacttcgtcgacggttttcgccgacagtccaatgatcgcgtcaggtccaagcagctttcgtgccaccactggatcgaggtcgtcctgacctatgtgcaccccgtcgaccttgatgcccttggcacgggcctcgagcgcggcatcgacccggtcgtcgaccacaaaggccaccgagtgctccacgtgatggcctgcgatctcttcggcgatgtcgttcgccagggagacgatctcggcgacatcctgggttttggcgcgcagctggatgaaactggcgcctccgtcgagggccttggccacgacgtcgagaatcggccggttgccgcaatcgtcggggccgaccacgaaatagaagcgcaggtcgaaacggtcgcgcatggatgggtatgggaacgagttcattgtgtcacctgattcgtttgttgtgtgccggcatgccgtgccatggcagattctaggccaaatagagcggtgcggaggcgatttcctccggcgtaacgttccacagagcgtcgaggaacgcggtttggaacgatcccggcccatgcgatgctcgttcggcggctccggaagatacgttgtagagcatcgaggcggccagtgatgccaccagtggatcggccactgcaagataggtggccgtgacacccccaagcgagcacccggcaccggtgatcttcgtcatcatcgcgcttccaccgggaagtcggtagacgagtcgtccgtcggtgacgagatcgacctcgccggagaccgcgacggcccccgtgtgggtgggggagtggagcgccagatacgccgccagatcggtggccgcggtgatggcggcatccacactgtcggcggcctccacgcctgcgggcccattgtgctcatccgttccggctgcatcgcccagttgccacatgtcgtgcaacaccagtgcctccgatgcgttggcgcggatgacggtgggagggtaatccttgaaccccttgaggatctcggtgcgcgcgacgccaacgccggctgccaccgggtcgagcacccacttgcagccatggcggctcagatgctccgagatctcctgcagtgcatcgcggtagaacggcagcagcgtgcccacgttgatgtatgtggcaccgcacgaagaggccaacgaggtcacatcgttgggaaggaagctcatggcggcggtgccccccgcggcgagctgcgcattggccaccagattaatggtgacgaaattggtgaatgactgcgcaagcggggtctgctcgcgaacattctgcgccgcctggcgtatacgctcacgaatggggtcgtctggtgcgacctcgtgtagattggatgtgtcggaattcggcgtggtcgacgctgtggtcatctgtactccctactctggtgctagccaacaggttcgaagggttaggcgcgaagccactctcagctctatcagctcccctgacatgtgtattccaaacgtattgaacactctcgacgcctgctgtgctcatgcgtgtcatcaccccacatgggcaccggaacgggctccctgcgtgtcagccgccaacggtagggtgaagccttgtataagaccccaaaccgttcaaaccagaaggtgcattgtggctaattccaaaatcgatgaagttgtctccctcgccaagcgtcgcggcttcgtgttcccggccggcgagatctacggtggcacccgctctgcgtgggactacgggccgctcggcgtggcgctcaaagacaacatcaagcgcgaatggtggcgctcgatggtcgtcacccgaccagatgtcgtgggcgtcgacacgtcgatcatcctgccgtccgaggtgtgggtcgcctccggccacgtgtcggtgttcaacgatccacttatcgaatgcctcacctgccacaagcgtcatcgcgccgacaagctcgaggagtcgtatgccgagaagcacaacgaccagctgcccccgaatggcctcaaggacatcgtgtgcccggactgcggcacccgcggcaattggaccgaaccccgtgacttcaacatgatgctgcgtacgcacctcggtcctgtggaagatgagaacagcctccattatctgcgaccggagacggcacagggcatcttcgtggacttcaagaacgtgatgacctcgtcgcgctccaagccgccgttcggcatcgccaacaccggcaagagcttccgcaacgagatcacgccaggcaacttcatcttccgtacccgcgagttcgagcagatggagatggagttcttcgttgagccgggcaccgatgaggactggcatcagtactggatcaacgcccgcacacagtggtacatcgacctcggtgtgaaccccgagaatctgcgccattacgagcatccgaaggaaaagctcgcacactattcgaagcgcaccgtcgacatcgaataccgcttcggcttccagggctccgattggggtgagctcgagggcgtggccaaccgtaccgatttcgatctcggcgcccatgccaagcattccggcgaggacctgagctacttcaaccaggccaccggcgagaagtacattccgtacgtcatcgagcctgcagccggtctgtcgcgttcgctcatggccttccttgtggatgcctacgacgttgacgaggccccgaacaccaagggcggcgtagacaagcgcacggtgctgcgtctcgacccgcgtctcgctcccgtcaaggccgcggtgctaccgttgagcaagaagccggaactgcagtcggtggcccaggacctcgcgcaggatctgcgtctcaatgactggatgatcgactacgacgaatccggtgcgatcggccgccgctatcgtcgacaggacgagatcggcaccccgctgtgcatcaccgtcgacttcgacactcttgatgaccaggccgtgacgattcgcgagcgtgacacgatgcagcaggagcgcgtggcgctcacccaggttgccgactacgtggccaagcgcatcaacgacaaacgtacacgtgtgccgctcaaaccggtgtcgatgggtggcgccgaatggcccgagaccgtgcatatcgccgaggccggcggtttgtactgatctgccatgcatcaatcgcctgcgccccgtatgcctgagattgcgggacgcaggcgattttgcgtacgaggcgagcgtgcgaataattcatacgatactctgtacaattcggacacatgaacgaggggatatgagcgagcaggagacgatactgaacacatcccggcaacgcgaggcaagcccagatgccaaggattgcgcagatgccggtgcacggcttgaaccggttttggccggtccgttggcaccgatcaggctcggcgatgtcatggtgaacactccggtcatgctctccccgatggcaggtgtgacgaactggccgttccgtgtgctgtgcgaggaatatgggcccgacggcctttacgtggccgagatggtcactgcacgcgcgctggtcgagcgcaatccgaaggcgctcaggttgtgcaggttcgcaccgagcgagcgcatcagatcgctgcagctgtatggcgtgaacccgtcgattatggaacaagcggcgcggttcctggtggacaacggcatgatggatcatctcgatctcaatttcgggtgcccggttcccaaagtcacccggcgtggtggaggatcggccttgccatggaaaacggatctgttcaccgagattgtccagcgcgtagttgcggtgtgcgagccggcgaacattccggtgaccgcgaagatccgcgtggggctggaccatgagcatgagaccttcctcgaagccgggcgcatagctcaggaggaggggtgcagcgcagtgaccctgcatgcccgcaccactgccgaatactatggcggtcattcggattggtgccggatcggtgagctcgtgagcacgctcgacataccggtgttcggcaacggcgacatctggggtgccgaggacgccatcgcgatggtgaacgaaaccgggtgtgccggagtggcgatcggtcgcgggtgccaagggcggccatggctcttcggcaatataggcaacgccttcgccggcagcgacgtgcgtatcaaccccaccctcggcgaggtggggcgcatcatcatgcgccatgccgagctgctcaccgagttctacgatggtgacgagcggatggctgtgcacgacctgcgtaagcatgtcgcatggtacctgaaagggttcccggtggggggctccaccaggcgcgcgttcatggaatgcgagagtttgaaggatgttcgtgagcaggtggacgcgcttgacccgaacatcgagtatcctgaacgggtggtggaccagccgaggggtcgtgttcgctttgcgaagaaggtgcatttgccatatggttggctcgattcgcggaccacgacccacgaggagcgcgagcgactgttcggcgacgacccgatggatgcgagctactgagcgacacgttttaagaaaactttcggaaatcgggtctacggtgtctacgaggaatgtaaagaggagggtgagcggattggccttggccagtggagggaggcctgttttctcacccatctgcggtacagttgtgtacaaccgtgagtgacaggagactaacgtgagcgagatcgcccagaccgacaatttcaacgacaccacgatcatcaaggtcgttggtgtcggtggcgcaggtggcaatgcagtcaaccgaatgattgccgagggtctgcagaatgtggaattcgtggcaatcaacacggatgcgaaagatttgctgcgttccgacgccgatgtcaagatctcgctgagcgacgcctcgagccgagggctcggcgcgggggcggatccggagaagggcgcgaaggccgcccaggatcaccagtccgagatcgaagaggccgtcaagggcgccgacatggtgttcgtcacctgcggtgagggcggtggcaccggcaccggtgcaagcccactggtcgcccgcgcagcacgccagcagggcgcgctcaccattgcagtcgtcactcgtccgttctccttcgaaggcccgcagcgtgccgcctcggcagcgctgggcatcgacaatctgcgcgaagaggtcgacgcgctcatcgtcattccgaacgaccgacttcttgaactcgacgacagctccatcggcatcgtggatgcgttccgcacggccgacaccgctctgctcgctggtgttcagggcatcacggacctgctcacgatcaatccgtacattcacgtcgatttctccgatatcacgtcgatcctgcagaactccggcactgcactcttcggcatcggcgccgcacggggcgaggatcgtgcagcgcaggccgcagagatcgccatcagctcgccattgctcgaggagagcatcgacggcgccagcggcgtgctcattaacatcgcggcttcgaacgacctgaagctcgccgaggtgaatcaggccgtcggtttcgttcgcgaggccgcacatccggaggcgcagattatctttggtctcgcactcgacgatgcctatggcgatgagatgcgcgtcaccgtgattgccgccggcttcaacgacaagaagaagctcgctcaggccaatgaggacgcccaggccgccgcctcggcgcctcagcgcaccgtcaaaccggtgaccaagaccgccacggcttccgggcagcccaccatcctcacgtctcccattccctccaccggtccggtgttcgaagaggagaagaagacggatgagaagatcgtggcccagcagccgacgccgaagcaacgctccgaatacgatgcctcgtccgacaccagcagctatccgtatacggcgcttggtgatctgggtgacctcgacattccggagttcctgcagtagtcgatccgcttacggcacggtctgaattacaatacctgtagaacccaaagagtcaacctgaaacaggacagcaaagaaggaaacgcgaatggccggattcatgaagaggaccatgtcttatctgggaatgtccgacgtcgtgccggaagacgaagatgacgaggtcattgacgaggagccggagtcgtcattcgacaccgatcgttccgtcacgcccatcccggccgcgtccacgcagccttccacgagccagcgtaagtcggtggccccgttccatgcgaacatcaatcggatcacgaccattcacccgcagagctacgaagatgcgcaactggtcggtcgcgcactgcgagacggcattccggtggtgctcaatctcaccgatgtctcgcagtcacaggcttaccgcatcatcgatttctcgtccggcgtggtgttcggcatctccggctccatcgaacgcgtgaccgagcgtgtgttcctgctgagtcccgctcgtgtggacattgtcgcggaggacactgaatcgggtatgtcagacaacctgttcgagaactgatgaggcggggcagcggcccccacattcacgtcatttgctgttcgaggaagcatgttcctagtcattcgataggctgggagcatgctttcgacgttattcggcttcttcttccatattgtcgacctgctcatcgaggcctacatcgcggtgctgttcgcccgcatgatcttcgattgggtgctggtgctggctccgcgatggcggccgaccggttttgtggcgaccctgctgcgcatcatctaccagctcaccgagccaccactgcgcttcctgagacgatacatcaagccgattcccctggggcgcgtttacttcgatgtgagttttctggtgttgtatttcgtattggtgatcttgcgcatactgatctgaccgatggaaaaagtccgatggtcatgtgaaaaaagccgcccatgcggtgtgcttgcgcaggtgtcgtgatagcatcaaaaaataaggtcaactaagctgggtctatcccaaagcgaggtggtaagataatggctcttttgacgccaaaggatattcgggagcacaccttccaaacggtgcgcttcaaggaagggtacgatgtcgacgaggtcgatgacttcctcgatcaggtaaccgaaaccgtggaggctttgggcaagcaggctgttgcaggtggtcagtccacgcaggcactcggccctgatgtctccgcgctgaacacgaagatttccgatttgactgcacaggtgcagtccctgcagcaggagaaccagtcgctcaaggccgccgccgcgcaaggtgcaggcgaacaggcgacggcgcagatcgcccaggcgaatcaggccgcacaggctgcacaggcgcagctcaaggaagccgagtcgaacaatcaggcgctttccactcagaatgaacagctgaagaaccagattgaacgcctttccgcgcaggtcgatcagctcaccgcacaggcggcgcagaactccgatcagccggatctcgccaaggagctgcaggagattacccgccagcgcgatcagttccgcgccgacagcgagaatctgcgtcatgagctctccgctgcccacgagcagacgatgcgcgcccagcaggccgaagcccaggtcaaggacctcaccaagcaactcgaggaatcgaagcagcgtgaggaacagctgcgcgatcaggtggccaaggtcgaaccgaacactgagacgggcagcctgcagaagatcaagagcgctgctgcggccgccaacagcgagccggagcgcgccaccgcgatgctcaccctcgcgatgcagctgcacgaccagtacgtcgacaagggcaaggcgaccgccaaggagatcaccgagcaggcccagcgcaagtatgaggagctcatctccaaggccaacgactattcgaaccgcactcgttccgaggccgacgattacaatgcccgcacccgcgaggctgccgatgcctacagtgcgaagactcgtgacgatgccgattcgtacagcgccaagacgcatgaagatgccgacacatacatgaagaacaagcacgccgaggcggatcagtacgtggtcgacaagaccaatgaggcgaacacctacgcggatcagaagatcgcagaggcgaacaactacgccgccgccaagaccaacgaggccgacacctatgccgactcgaaggcccatgaggcagacgaatacgctcagaagaagcaggacgagggcaacacctacgcccagcagaagaagagcgaggccgaccagtacgtggtcgaacgccacgacgagatcaacgcattcgaggccgaagccaagaagcgtgccgacgactactcggcgaagacccgcaccgctgccgacgactacgcccagcaggtgcgtgagaacctcgagacccagtcgaaggtgatcgaaggcaacattcagggcctcaagaccttcgagaccgaataccgtgcacgcctcaccgagttcctcggccagctgcaggcacaggtctccgacacgaacaactacaaggacatcgacaaggccaactgataccattagccaatgttgaattcgaaaccaagacggccgcgtgtacgcgtggccgtctttgcatgtatcgccatcgtcgcccttggggcagaccagcttagcaaatacctggcgcagacctacctgaccgagaccgattacattcaggtgatcccacggttcctgcacctgacgttggtccataatcccggggcctcgctgggcatgggggccaactcgacctgggtgatcagcctcttcgccattgtcgcatgctgtgtgcttgtctggatggcctggcgcaccacatcgatggcctggaccgtgttcctggcactcgccttcgccggggcgttggggaacctgatcgatcgcgtggcatatgcccaaggattcctcaatggcaaggtcgtcgatttcctcaattacggttggtcagtgggcaatgtggccgacatcttcctcatgatcgcgggaataggcatcatcgtgctcattctgtgtggagtgccctatagggggagcgacgagcgacagccggctgatacagcggctgccggacattccgataactaggcatatggaaggagctcaatgagcacgatcattccggcgcccgatgcactgatcgggaagcggttcgatgtggctgtggccaagatgatgggcatctcacgggccaaggccactgaactcatcgaaaccgggcaggcacgtgtgatcgggcgtgatatccataaatccgccacattgcaagcaggcgacaccgttgagattgatgtgcgagaagagagacgggaacccgaacccgtttcgaacgaaatgacgattgcctatgaggacgacgacatcgtggtagtggataaaccggtcggtgtggcggcgcatgcctcggtcggctggaccgggccaacagtgctgggttcgttgatccagcgcggtgtgcacatcacctcgatgggggctgcgggacggcagggcattgtctcgcggcttgatgtgggcacctcagggctcatgctcgtatgcaaatccgacctcgcctacaaggagatgcgcaggcaattctccgagcatgaggtgaagaagacctaccatgcgctcgtgcaaggcaatctcaaggaagacaaggccaccatcgaagctccgatcgggcgggcaaaggtctccgatttccgcttcacggtcacgcccgcgggcaaggaggccgtcacccattgggacgtgatggaacgcttcggcgaggccacactcgcgtcaatcaatctcgagaccggacgcacccaccagatccgcgtgcatttctcgtccatcgggcaccctcttgtaggagacccgatgtacggggccaatccccgtctgtctcaggcactggggctcgaacgtcaatggctgcacgccatggagctggagttccggcatccgcgcacgcacatcaacaccgtggtcacctcgcggtaccccaccgatctgcagcatgcgctggagacggagcgtgagcgcttcgcccaacgggagcaccagcgtttagagtcgtcgcgagggtgacgatggcggtgatttcccgcgactggcttccgtaatcgccaataccacgaatatgatcatcgcgcaggtcggcataacggccaacggcgtggtgaacaacagactggtccacgcctccagctcgcgcaccccggtggaatagccggccgcatgatcgcagccaagcagaatgcgaatggcctgcaccatgccgatggctccgggaagggcaagcagggcgcagagtggaatgagcgccacatatacggcgatgcgcctgccgcgggccggcttcgatgccgtcataggcagccttccttccctcgcgtcgacttactcggcaatgttgccaacactctagcgacgaggcgacgctgtttccatatgaagcgattgatgcgctggaaatgccgcgtgtcgaaacggacatggcgtgttcgaagggttgcggggcaccccggttcgcgctctgtacagcaagcggatttcaaggtacattagaacactatgaccaattccgctgatttcgtgcagttgcacaaccatacgcattattcgttgcttgatggtgcatcgaagattcccgatctggtgaagtacacgaaggaattgggaatgggtgccgtgggcatcacggaccatggcaacatgcatggcgcgtatgagatgtacaccgaggcggtgaagcaggatgtcaagccgatcatcggcatcgaggcttatgtgacgccggagacggcgaggcaagacaaatcgcgcgtgcattggggcacggaggcgcaacggcgtgatgatgtgtccggtggaggcctgatcacgcatttgacgctgtgggccgaggacgacgaaggattgaggaacctgatcagggcctcttcggtggcgaatctcgaaggacgtgtgatgcgctatccgcgtatggacaaggaggtgctctccacctacagcaaaggcgtgatctgcggttcgggatgcccgtcaggcattgtgcagacccgtttgcgcctcggtcagttcgatgaggccttgcgtgcggcgggtgagttgcaggacatctatggcaaagacaatttcttcattgagctgatggaccataatctcgagatcgagcgcaaggtgacgaaggacctgcttgagatcgcgaagaagctcggtgcgccgctgctggccacgaacgattcgcattacgtccacgaggaggatgctggcgcgcaggacgcgatgctgtgcatcaattcaggctcgcacctggatgatccggaccggttcaagttcgatggagaagggtattacatgcgttccgcgcagcagatgcgcgagctgttccgcgacctgcccgaggcgtgcgacaatacgatcgaggtggcggaacgttgcaatgtgatgttcgacgaccacgaggacggcgcgttcatgcccaagttcccatgcccggagggttgggacgagacctcgctgttcctgaagaaagtggaggagggcctcgaacggcggtacgagggcaatgtgccggcgcatgtgctggcgcaggcggattacgagtgcggtgtgatctgccagatgcaattcccaggctacttcctggtggtggctgattacatccaatgggccaaagaccatgggatcatggtggggccgggccgtggctccgcggcaggatcgatggtcgcctatgcaatgggcatcaccgagctcgatcccctggagcatggtctgatcttcgaacggttcctgaacccggagcgcgtgtcgctgccggatatcgacgtggacttcgacccggagggccgtctgaaggtgatcgagtactgcggcgacaaatacgggcacgacaaggtggcgcaatgcgtgatctacggcacgatcaagacgaagcaggcgctcaaggattcagcgcgcatcatgggctacgagttctcgatgggcgagttggttaccaaggcgttgccgccggcggcaacgggtggcaaggacgtgccgctgcacgacattttcgatccaggtgcgaaacgctatgcggaggcgcgtgaataccgcgaattgtatgagtcgaatcccgatgccaagcgaatcaccgacgaggcgatgggcatcgagggcctgattcgccagacgggtgtgcacgcatgcgccacgatcatgggctcggagccgatcactgacacgtcgccgctgctggagcgcacggatggcacggtgacgacgacattcgaataccacacgtgtgagacattgggtctggtgaagatggacttcctgggtctgtccaacttgacggtgatcggtgacacgctcaggaacatcgaggccaacggcaaggaaccgattgaccatacgaagattccgctcgacgacaaggagacatacgaactgctgtcgcgcggcgacacgctgggtgtgttccagctcgattccgacggcatgcgtgcgctgctcaagcagctgaagccagataacttcaacgacatctcggcattgatcgccctctaccgtccgggcccgatgagcatggactcgcatacgaactacgcgaaacgcaagaacgggttgcagaagatcgagccgatccatccggagcttgccgagccgctcaaggaggtgctcgacgagacctacggcctgatcatctaccaagaacaggtgcaatccgccgcccgtattctggccggctattcgctgggcaaggccgacgtgctcaggcgcgcgatgggcaagaagaagcccgaggtgctggccaaggaacaggtgccgttcttcgaaggcatgaaggagcacggctattcccgcgaggcggcgcaggcggtgtgggacgtgctcgtgccgttctcgggctatgcgttcaacaaggcgcattccgccgcctacgggctcatctcgtattggaccgcctatttgaagacgcactatccggccgagttcatggccgccctgttgcaaggcgcctccacgaacaaggacaagaccgccctgtacctaggcgaggcgcgccgcatgggcatcaaggtactctcgccggatgtcaacgaatccgtgtacgcctactccgccgtcggtgatgtggtgcgtttcggactcggtgccatcaggaacgtgggtgaaaaggcagtcgccgacatcattgccgagcgtcagggcagccacggcaggtacgtcaacttcatggacttcattcgccgtgtgcctctgaccgcactcaataggcggttggtcgaatcgttgatcaaggcgggtgccttcgactcgatcgaccccaaccggcgtgccctctaccagattcacgaggccgcgatcgactcggtcaccgacctcaaacgcaagcaggccactgggcagttcgacctcttcgccgacctcgacgccggtgccgacgatggcgaggccgaagcgcttggcgacgtgtcgatcagcgtacctgacgtggaggagtgggacaagaagaccaagctcaacttcgaacgcgaaatgctgggcctgtatgtgtccgaccacccgctttcaggcatgcagtccgtgctcgccagcctgcgtgacatgtccatcgcgcaactgatcgaccgtgctcccacgatgcccgagcgcagtcaggtcatggtcgccgggctcatcaccaacgtcgactcacgcgtctccaagaaaggcaaccgatgggcgatcgtgacgattgaagacatggagagctccatccaatgcctgctgttcggcaaggtgtacgaggcgcacgcggcggaactcgccatcgacacgatcgtgcaggtgcgtggcatggtcgaggcacgtgacgagacgatttcgttgcgcgccaccgacctcatggtgcccgtcatcgaagccggtgaggaccgtcctgttttcgtccagctgcctgcgcacgccctcgatatgcaacggctcgaacagttctcgcagatcctctccaatcatcccggtgcctgcgaggtcaggcttgccatcgtcgacgacaatggcggcgtgaccctcatgaccctcggcgatcgcttccgtgtgcgtcgtgagaccggcctgttcgccgacatcaaggttctttttggcgccaacgcactgcctatgatctgaacggcggtttgtgcgaacggagacggcatgcgatggcatgccgtctccgttcgcacaaaccggatgcctgccatctctcatttccgcgtctgatctttgtcattgttttgcgtaatctggaactaatttcacacgggatgcgtccccgattacgtggatttgctgaattaacgcgaacctacggaactcgtcggggcgcgccagcgggcaatctcacgatgcaaaagacccgatgccctcgttttccttctcgtgacaggcgcttggtaccatagtggcttatgagccaagataactatatgcgcatcattgatttgcgcggcaaggaactgacacgcgccgagatgcttgacgcgatgccacgagctgagatgggaaccgacgaagcgagcgagatcgtgcagccgattctcgacaacgtgagggagaacggcgccgcagcgttgcgtgaatatgccgagaaattcgaccacatcgtccccaagtcgttccgtgtacccaccgacgtcatggatgccgccgtggcgtgcctcgacccggaagtgcgcgcagcgattgaggaatccgtgcgccgtgcccgcgcagtcgcgaaatcgcaggtcccagaggacttccataccgatttggctgagggtgcgcgcgtcagtgagcgctggatcccgatccagcgtgtgggtctgtacgtgcccggcggcaaggccgtgtacccgagttccgtgatcatgaacgtggtgccggcacaggccgccggtgtcgaaagcctcgccatcgccacgccgccaagccgtgacaatgcgcagggttggccgaacaagacgattctggccacctgtgccattctcggtgtggacgaggtctacgccgtcggtggtgcacaggccatcgcgatgttcgcctatggcgccaccgacctcgacaatccggtctccccggtgctgtgcgagccggtggacaagatcactggtccgggcaacatcttcgtggccacggccaagcgtctcgtttcgggcattgtgggcatcgacgcggtcgccggccccaccgagatcgccatcatcgccgacaagacctcgaacccggcatatgtcgccgccgacctcattggtcaggccgagcacgatgaactcgccggatcggtgctcatcaccgacgacgatcagttggccgaggcggtgcaggccgagctcaacaagcgcgtaccgcgcaccgagcactccgaacgtgtggccaccagcctctccggcaagcagtccggcatcattctcaccgacggcatcgagcagtcgatcgacgcggcgaacgcctacgccgccgaacatcttgaagtgcagaccgcagacccggatgccgtgatcgcgaagatccgcaacgcgggggccatcttccgcggcaactattccccggtgccgctgggcgactacatgtcgggctcgaaccatgtgctgcccacctcgggcaccgcacgattcgccgccggtctcggtgtgcacacgttcatgaagccggtggaggtcatcgaatacgacgagcagggactgaaggagctcgccgccagggtgaatgccctcgccgtctcggaagacctcccggcgcacggcgagagcgtgctgacgcgcttcattgacgatccgtacaacaaggaaaccattaccgaacaggaagaagaagcaggattacgatgagcgaagcgatgattccggcggatctgccactgcgtaacgacctcattggcgaggtgccctacggcgccccgcagctcgacgttccggtgtgcctgaacgtcaatgagaacccgtatccgccggatcacgccgtggttcgcagcatagtggagcacgtcaagcaggtggcgcctaccctcaaccgctatccggaccgcgagcacatcgaactgcgcgaggccttcgtcaggtacctcaaggaggaatcgggggcgcagctcaccgtggaacaggtgtggggcgccaacggctccaacgagatcatgctccagctgttccaggctttcggaggccctggccgtgccgcactgggctgtgacccggcctattcgatgtaccccgagtatgcacgcgacacgttcacgagttggtacaccacgcaccgcaagccggacttcacccttgatgtggaccataccatcgatgacatcgatgcgatccagccggccatggtggtgctcaccagcccgaacaatccgaccggcaccgaactgcctatgaccgatctcaagcgcattctcgaacattgccagagtgctcaggtcgctggtgcacacgatggggtgcacccgatcgtggttgtggatgaggcctacattgaattccgcaacccgggcacgccgtcggccacgacgctcatcaacgactacgacaatctggccgtgagccgcaccatgagcaaggcattcgcgtttgcgggagcccgagtgggctatctggcggccagcgagggtattgtggactgcctgcgcatcgtgcgcatgccataccatctgtccgccgtgacgcaggcggtggcgctggcggccttcgaccataggaaggaacagctgagccaggtggaccacctgcgcgagattcgcgagcagaccgccgcttggctcaaggaacagacctataagggccagccactcgaagtcgccccctcgcagtcgaatttcctgctgttcggcggccatttcgatgatcgcggagccatcttcgaccaaatgctccagcgtggcgtgctcattcgcgtggtggggccggaaggctggctgcgtgtgtgtatgggcactgacgaggagatgcgccgattccgcgaggcgctcgtcgaatcgatgcgcgccgtcgagaacgcctaggccgcagacatacgtatacctgcaaaggagacatggagacacatggcacgcaccgcgcacattgttcgccagaccagcgaatccagcatcgacctcgaactcaaccttgacggcaccggcaagacgaacatcgaaacgactgtgccgttctacaatcacatgatgactgcactgggcaagcattcgctcatcgatctcaacatcgtggcgagcggcgacaccgatatcgatgcccaccataccgtggaggacacggcgatcgtattcggggaggcattgcgccaggccctcggcgacaagcgcggcatccgccgcttcgccgatgccaccgttccgctcgacgaggcgctcgccaaagccgtcgtcgacgtctccggccgcccatactgcgtgtgctcgggcgaacccgaaggcttccagtacgcaatgatcggcggccacttcaccggctcgcttgtacgccatgtgatggaatcgatcgccttccacgcgcagatctgcctgcacatgcatctcattgccggccgtgacccacaccacattgcggaggcggagttcaaggcgctcgcccgcgcattgcgcttcgccatagaacccgatccccgtattcaggggctgatcccgagcacgaagggcgcgttgtgatgtcagacgacgacaagcgaaatcccaacaatcccgataaccccggcgacgaaaacgacgcgttctgggccttcgaaagcgatccggatctcgcacgtgagatggagagcctcaaccaggagcttgcgaatctcgagcagaatgcgagcaccgacgatgccggggaatccgcgaccggggaatcggaagacggcaatgctcccgaagacgtgtccgacgagttctcgcagatcatgaacgcgaacgccgagataggcttcgacgacgaactcgaggggattctcggcaacaaggcgaagcgtgcgattctagtcacgcgcctcacctcggccgatttgctcgccgccttctgctcgctcgccgacatcaccgcgcaatgcatcgattcgcgtgagggtgcggtggcagtgctgcgcaatctcaacggggacggtcccgaggcggccgcgaaggacctcaccgaagtggtggcggggctgagcgtgctgttgctcgtggatcgcgccgacaagatgaccgccgttccctatgcgaacggcaccgccgaggatgcggaactgccgccgccgttcgtgctggagacgctcgcgcatttcgtggaggatctcatgctcggactcaccacggtcgatgcgctcgcgcagcagggtgtgaggattgtcgattccgcggatctggatcacgaccatgcattgaaaatcatcgccgagcatacgaacttcgggcgtgacggctcgtcgatcgactgaatgcacggggcacaggaagaaagtgagattatgaaatctgtagtcgtatttgattatgggttcggcaatgtgcgctccatgatgcgcgcactcgccaatcaggaccttgacgtcacgctcacctccgattaccgcaaggccctggaggccgacggtctcgtcgtaccgggcgtgggcgcattcggtgcctgcatgcagggactgcgcaaggtgaatggcgacaacgtgatctacgaccgtctgcgtgcggggcgccctgtgctcggcgtgtgcgtgggtgagcagatcatgttcacccgtggcaccgagcatgaccttgacacgcctgggctgcagctcattgacggcgaggtgagcagactcgatgccgacgtggtgccccacataggctgggataccgtcgatgcccccgaaggctccgtgctgctcaatggcgtggagggcgaacggttctatttcgtgcactcctacgccgctttcaccgcggcgcccgcggatttgacgcagttcgacatcgacctcggcgacgccgagcagaaagtggcgttctgcgattacagccgcagccatttcgtggccagctatgagcgcgggcctctgttcgccacgcagttccacccggagaagtccgcgcaggcaggtgccagactgctcgcgaactgggccgccgtactctagttatgttgttatttgccgtattttaagattccagattggagtagaacatgtcactgactttgttgccggccgttgacgtccgtgacggcaaggccgtccgtttacgtcaaggtgagtccggttcggagacggactatggctcgccgctcgacgccgcacgcacgtgggtggacgccggggcgcagtggatccacttggtcgatctcgacgccgccttcggcacgggggacaaccgcgcccaattgcgtgagatcgtcaggcagctcggagacaaggtgaacatcgagatgtcgggcggcgtgcgtgacgatgcctccctggatgccgcgctcgacgccggcgccgcacgtgtgaacatcggcaccgccgcactggagaatccggagtggacggcccgtgtgattgacaaatatggtgacaaggtggccgttggcctcgatgtgcgtggacatacgcttgccgcccgcggttgggtgaaggagggcggtggcctgttcgagacgatgcggttcctcgacgacgcgggctgctcacgctacgtggtcaccgacgtgacccgcgatggcatgatgagcgggccgaacatcgatctgctgcgtgaagtggccgagcgcaccgatgccagagtgaccgcctccggtggcatctcgaagctcgacgatctgcgtgccatcaaggagctgctgccgcttggcgtcgattccgcgattctgggcaagagcctctacgcgggcgccttcacgctcgaagaggcacttgctgtagccaatgcgtgatattgcacagtgcgtcaattgaatggtgcgtcaatggggacattttctgccggatccccattgacgcaccatatgatcatatgcatgcattcgagttgtttgcgtcaccgaataacgggctatgcgcaagggagctcaccggatgcgatgagttgggtgaacagctcgaaatcgtcttcgttctggtcggcgtatgaatcgcagaagctcatcatcgccgtctcgaattcgtcgctgtcgcccaaatacccgctgatcgccacgctgtcgccgctgcgcgcatgcgcatgggcgagacaccacgcacacagcgagcccagattgctcaacgaatccgcatgcagcgtgtcaagatcaatggaacccttgccattccacagctgtcgcacgtaatagtcgcgcggcagaccatcgttggccacgaaccgcgaccacccgagcagaatgtcggcggtggactgcacgagcttctgaccttggatcacgcgctcaccgtgcgtgctgtagggtgagtggcccacgtatttggccagcacgctggccaccgcctccttcatttgcagaatgagcgggtcgtctatgtcacggcctatgaacgcgctgatccagcagcgggtgccaacggaaccgacgccgaccaccttgcgcgctgtgtcctgataatggtactgttcgagcacatggcggcggtcctcatacagcgaatcacggtaggtgtcgaacagctgtcgcaggcggccgcgcagcgcatcgatgtcctcgtagccgcgaatgtcgttgatctgcacgagctcgggtggctcggtcttgaaccggagtcgattgccgtcgagataggtgagcttgttggctgccttcttggagtccttcgaacgcgccttggctatggcgccgtgcaacgttttcgacggcttcgctttcatcgccttctccagatgggcgaggctgtcttctacatcgaaatgggtgtaccacgtgttgaggaagcccatctgcgagaattcccgtaatgtttcacggtactgtttcacgcaacgatagacggcatcatgacgctccttctccttgagccctatgttgcgccccgcaatctccaccgaaacggcaagtcgcttgatatcccattcccatgggcccgtggccgtctcgtcgaagtcgttgatgtcgaacacgagacgtttggacggcgaatagaagatgccgaagttgcctatgtgcgcatctcctatgcactgcaccggaatgcaggtggtaggggtgcgggcgagatcgttcgccatgatcgccgcgccccctcggtagaaggtgaaggcgtttgcgctcatgcgcttgaaccgcagcggcaccaggtcgggaacgcgcatcttgttctgctcctcgagcagaccgatcacgtcacgccgcttcgtttgcacgcgccatacggcatgcgaggagagagggaagcgttcgcggagtttgagaccggcgttcgtgcgatcctcggggttcttgaactccgtccatgcgctcatgtcgaacatcggatgcgcttcgcttgactctacaagatttccatcgctcatacttgcacaataccgtgcgggcaggcacaattcgtgtttatacggcgttccgtgcggattccgtccgtatatcgatgcggtgtccacataccgtctgttaacgcgtgccgtaacatcggtttgaaacgatggggtgctatggacaaacaacaagaatttgcgctccgaaccgttgaggaacgcgatgttcgcttcattcgcctgtggttcacggatgtattgggaacattgaaatcggtggccatcgcgcctgcagagctggaggccgcattcgaggagggcattggtttcgatggctccgcgatcgaaggcatgacgcgtgtgtctgaagacgacatgatcgtcaagcccgacccgagcaccttccagattctgccgtggcgcggaggtccccaaggcacggcgcgtatgttctgcgacgtgctcactccggagggcgagccctcgctctccgacccacgccatgtgctcaagcgttcgctgtcgaaggccaaggagaagggcttcacgttctacgtgcacccggagatcgagttctacctgttcgagaagcaggacgactggtccaagagccccgtgccgatcgatcagggcggctatttcgaccatgtgccacgcagtccaggcatggatttccgccgcgccaccgtcaacatgctcgagcagatgggcatctcggtcgaatactcgcatcacgaggcgggccccggccagaatgagatcgacctgcggtatgccgatgcgttgacgatcgccgacaacatcatgaccttccgtacggtggtcaaggagatctctctcgaacgcggcatccatgcgagtttcatgcccaagccgctcgcggacgcgccaggttcgggcatgcacacgcacctgagcctgttcgaaggggatgcgaacgcgttctacgaggccggtcaggagttcaacatgtcgctgacggcccggcagttcgctgcgggtattctgcaccatgctgccgagatctgcgccgtcactgaccagtacgtgaactcctacaagcgtctgtggggaggcaacgaggccccgagctacatctgctgggggcacaacaaccgttcggctctgcttcgcattccacagtacaagccaggcaagggcaactccgcgcgcatcgagttccgcgcgctcgatccgggcgcgaacccgtacctcgcctattcggtgctgctggcggcaggcctcgatggcatcgaaaagaagatgaccttgggcgagcctacgagtgatgacgtgtgggagctcaccgacgccgagcgtcaggcgatgggcattcagccgctgcccgagtcgctggacgaggccctgaagatcatggagaaatccgatttcgtggccgatgtgctcggcgagcatctcttcgagttcttcctgcgcaacaagcgcaaggaatgggaggagtaccgcagtcaggtgacgcccttcgaactcaagaagtacctggccaagctctgagctgtcaatgtgaatgtgacgagaaaagcggcggggtgttccgaatgtgattcggaacaccccgccgcttggatatgcatgcacatggggaaactaacgcagtgccttctggatgcgctgcacacttaccgggtaaggagtgccgagctcttgcgcccagagcgacacgtagaactcctcgagcatccagcgtgccttgagcgccttggccatgagctcgtcgtgcttggccccggccggctccttgcgtgccttttcgagcgctttgtcgacgatttgtttggcttcgtcggcctgccacgcccagcgcacatcgcggttcttgtcggttttcgccttggagagtctgatcatgtcggcctgcaggtagaccggcagtctgcggaatgaatcgggcggcgtggcgccgatgaaaccgggatgcacgagtgtggcgatatgttcgcgcaccgactgcagcaccgagagcatgggcaggtcggccttgccgctgaccgccttgtctacctgcgcataggcccgcagcacctcgatcgcgtccttggccacctcatacacggcgtcctcgaacacttctttgacgccatccacggcctcactcaacgcctcgtcggagctcagtttcgcaatgtctggcagcaatcgcttcaccgtctgcaactgcaggttgtcggcgagcgccttcgtggtcgaatacggagccgatgcgagcatgagggcctcggcaccgagccagcgtgacgagatgcgttcggcaggcaggcgcagccgatcgagcgcccctcgccagagcatctcctcgcgcgcctccgtggtggcaccggctttgcgcagcagatccgcctcggccaccacctgaccctgctcggcggccttctgggcctgccggtgcacgattttgcgtgcggattcctgcgcctgttcggcaaactggcgctgtagctcgaccagcgacttgcctgtgccgagcaccaccacgccatcgtcgtacgaacggcggcggtgggcacgcttcggccggggcttcggctgctcgatcacgaaattcatgcgcaggtatggcggcagcttgtcggcgaggccatcgagcacctccgggtgaatctgcgccccgaccacctcgatggcggcctgtgtgaacacgtgcgcgaaatccggccacacgcccccgtcaacctgtgcaggggaatccagtgtgccggaacccgggtcggtttggaaatgggagtcgatccagtcctcgatcttcgtcgcggtgtctggcgccggcacgaactgcacgcgcagcgccttcggcaatgccttgatcatcgccacaatgagctcatgacgcagcccgggcacattccagctgaactgcggtgccgagatgcgtgagagcacgccgagcggaatgtgcacggtgacgccgtccgcaggatcgtgcgtgtcgtaaacgtagctcagccgcagctcaatcacacgctcgtcggaaccgacggcgacccagtggtcggggaagtcctccatgctcaccgattcctgatcgaggagccgctccaccttggacggatcgaaatcaagcagatgcgggtgagcctcaaactcgcccttccaccatttcgccaggtcagccacgcaggtcaccgtgttcggaatcacctcgttgtagaaatcgtacagatcctcgtcgctcaccgtctgcgccacctgacgtgtgcgattcgactcctcctgggcctcctcgataaccgaccggttggcgtcgatgaactcgtcgtgcgcgaaccgctgctgaatctcaccttccacaagtccctgacgaatcaggaaatcacgagcctcgagcgggttgatgcgcccccactgcacggtgcgcccctgcacgatgggcagcccatacagcagcacattcgattccgccactgcggagccacgtgaggcggaccagtgcgggttcgcatacgtggtgcgggtcagattgccggcgagcggctccgcccacgcagggtcgattgcagcgcagtagcgcgcccacaaccggctcgtctgcacgagttcggtgctcatcacccagctcggcgtggatttcgagagtgccgacgccgggaaaatcgcgaaatgcgtgcctcgcgcacccaagtaatcgttcttcgccatcttctgtgcacgtttcatcgcccgcgctcgggcggcacccttgagaccggtgaaatcagatgccttcggctcatgcacgacctgcatgcccatcatcgagaggagaccggccaacatggaggtgtgaatgccttggctgtcccatgaacaggcgagcgaatgcgcagcctgctggctgatcggcagttcccggatctcacgcggcggtcgcgacaccggaatcggttcgcccacattgaacttgagttcgcggcacagttcgcgcagctgcgagacgagatccctccactggcgcatacgcaggaaatgcaggtattcagtcttgcacagcctgcgcagtgcatggctgctcatctcgccatccgccccatatgcgcggtcccatatgttcagtgcggtgagaaaatcactggtctcgtcggcgtagcggttgtggatgcaatccgcctcctcgcgcttctcctcggggcgttcacgcggatcctgcaggctcaggaacgccacgacgacgagcactgcggccaaggtgttcggcgtggtggagcgggcggcctcgatcaccatgcggcccagacgcacgtcaatcggtatgcgcgcaagctggcgcccggtgtgcgtcagttgcatgacgccgcgtttgcgagaaatcgcacgcaattcggtgagttcgttgatgccgtcggagaccgccttgatgtcaggcgggtcgatgaatccgaaatcggtgatgtcctccgccgtcctcgccacgcccaccgagagcatgtgcagcacgaccgcgccgagcgacgtgcgtagaatctccggctcggtgaaacgcgggcgtgactcgtaatcctcactcgaatacaggcggatcgcaatgccgtcggcgatacggccgcagcgacccgaacgctggtcggcactcgcctgcgagatcggctcgatgggcagccgctgcactttcgcctgcttcgaatagcgcgagatacgcgcggtacccggatccaccacatagcgtatgcccggcaccgtgagcgatgtctcggccacgttcgtggcgatgacgatgcgctggtgcgtatgcggttcgaacacgcgatgctgttccttggcgctcagacgtgcgaacaacggcacgatctcgatggcgtccggcctgcgcatgtcggcggcacgcgggccgaaatgatggcggagcgcctgctcgaagtcgcggatgtcgcgctcgccggaggcgaacacgagaatgtcacgtggtccttggtcatgcgtggagagaatcgccaattcggtgcatgcgcgagcgaccgcggtgggcatgtccattgcctcggcgtccgggttcgtgatgtcgtcgccggccgttccgtccgcaaacccgggaacatgcctcatcagcgcgggagtgcctcccagcggctcatagcagatcgtgaccgggtacgtgcggccggagacctcgattaccggtacctcggtgcgcagtgcgtcttcgaaatgcttctggaacttcgccgaatcgattgtcgcggaggtgatgatgagcttcaggtcgcgacgcaacggcagcagggcggtgagatagccgagcaggaagtctatgttgagactgcgttcgtgcgcctcgtcgatgatgatcgtgtcatagcgtgtcagtttcggatcgcgttggatctgcgcgagcagaatgccgtcggtgaccacgcgcaggcgtgtcttcggcgagctttcgtcggtgaaccgcacctggtagccaatttcgtcgcccaggcgcacgcccatctcgtcggcgaggcgttcggccacggtgcgcgcggcgagacggcgtggctgcgtgtgcacaatctgcttgccatgcgagccgcgaccgagttcgagcaggatcttcggcagctgcgtggtcttgccggaaccggtttgcccggagatgatcaccacctgactggaacgcaccgcgttggcgatggcttcgcgtgcggccgagacaggcagctgatcggggtattcgaatttcataacgtctttctgaagataatcggtgttcaggtattgcgctgtgctaggcgagcttatgcacgtcaatcacccggtagcccttcgaactggcgtatttgcccacttcgtagccgtcgccgagatgctcggcaagccaggggatgagcgaatcggagcccagattgcgctgcaccaccaaataggcatggccgtcggagacgaggcgcggaagccactccatgagcagttcgtggagcgcttccttgccgatgcggatcggagggttcgaccagatcacgtcgaagcgcacgtcaccaggtacaacagccgcagtgccggcgtgaatattcccgcagccgttcgcctcggcgttgctgcgtgccagttcgatcgcgcgttcgttgacatcgaccgcgtatacggtggcctccggcgattccaatgcgagcgcgagcgcgatggcaccccagccgcaaccgagatcgaggaacgtgccctcaagcgggggcatgggcgcatgccggagcagcacggaggtgccaagatccacgcggtgtgccgagaagacgccattggatgtctcgacggtgaccggatggtcgcgcaatgtcacctcgagtgtcttgcgtacatcggcggactgtggcgcggagctgaagtactgttcgttcgccgtgccattcgacttgcccatgacatccccgtttccatgaaatactgaaatatttgccgtacctgtcttgttcactatacgtaccatgatataagaacgcttgcagttcaaaagaaaggcgcttttgaccatattcgagaacgggggccgcatgggcaacccgagatataccgaggattcgcagaccacagattcgcagaacgtgctcgacgggcagtcgcaggtgctgctcgacgacgaccacgccggctggcggggtgaggacgagacctggcgcgagcgtgaagggcgcaacgagctcaagcatgtggccggtctgggagagctcgaagacgtcaccgaggtcgaataccgcaaggttcggctggagaaggtcgtattggtgggggtgtggtcttcccgggagtcgacgttcgcgcaggccgaggagtcgttgcgcgagctcgccgcgctcgccgagacggcgggcgccgaggtgtgcgacggcgtgctgcagcagcggtcacggcctgatgggacgtcatatgtgggttccggcaaggcgcgtgagatagcggacatcgtcgccgcgaacgacgcggacacgatcatcgtggacgccgacctgccgccgagccaacggcgtgccttggaggatctgacccacgtcaaggtggtggaccgcaccgcggtgatcctcgacatcttcgcacagcatgccacctctcgtgaaggcaaggcccaggtggagctcgcgcagttgcagtacatgctgccgcgtctgcgcggttggggcgccgcattgtcacggcaggcgggcggccgggccgccggtgccgacgccggcatcggctcccgcggcccgggtgagacgaagatcgagatggaccgtcgtgtgatccgcacccgcatcgcgagactgcgcaagcagatcaaggagatgtcgggcacgcgcgaggtcaagcgcggatcacgccgacgttacggattgcctaccatcgccgtcgtcggttacacgaatgccggcaaatcgtcgctgaccaaccggctgaccggttcgaccgaactggtggagaacgcgctgttcgccaccctcgacacggcggtgcgccgcacgcagacgcgcgacggccgactctatgcctatgtggacaccgtcggtttcgtacgccggctgcccactaatttggtggaggcgttcaaatcgacgcttgaggagattgcagacgccgacctcatcgtgcacgtggtcgatgcctcgcaccccgatccgttctctcagatcgacgcggtgaacgaggtgctgcagaccatagacggtgtggagcgactgccggtgatcaccgtgttcaacaaggccgacctcattgacgatgccaaacgcgagcgtctgcatgcgctcgcacccgatgcgcatatcgtttcgtctgccaccggcgagggcgtggacgcattgcgggccgacgtcgagtcgatgctcgtcgatccggatgtgcatgtcgaggcgttgctgccatacaccgagggatcgttgctggcgaaggtccgcgagtatgggcgcctggagtcgctggaataccgcgatgacggcattatgctgcaggcttttgtggacgaaagactggcggcgcgaatcatggacgtggccctgcacgagacggatgccccggaacacggggagggcggggagtgatgcagatcacaccgatgctgtggtgtatacggctcgttgaaacatgctcgtattgtgttcgcattgaactataaaaagaatcgcgagaggcaccgctgtggcgcgattctgctaaagtacaggtgaaagatatgtgaatcccgccataagcgggtagtatgagaggtcgtcagtatggtgaattcgccaattaagccaaccaagcttgccatcgtcggagccggtgcagtcggttccactcttgcgttcgcggctgcggagcgtggcatcgcccgtgagatcgcattgcaggacatcgccaaggagcgtgtcgaggcagaggtgctcgacatgcagcacggttccagcttcttcccgaccgtttccatcgagggctccgacgaccctgaggtctgccgtgacgccgacatggtcgtcatcaccgccggcgcacgccagaagccgggtcagtcccgcctcgatctggccggtgccacgatcaacatcatgaagtcgatcatcccgaacatgctcaaggtcgccccgaacgcgatctacatgctcatcaccaacccggtggacatcgtcacccatgtcgccatgaagctctccggtctgccggcatcacgtatgttcggctccggcaccaacctcgactctgctcgtctgcgcttcctcatcgcccagcagaccggtgtgaacgtcaagaacgtgcacgcatacatcgccggtgagcacggcgattccgaggtcccgctgtgggcctccgccaccatcggcggcgttccgatgtgcgattggcaggcactgccgggccatgagccgctcgatgctgaggctcgcgagcgcatccaccaggaagtgaagaacgcggcctacaagatcatcaacggcaagggcgcgacgaactacgccatcgccatgtccggcgtcgacatcatcgaggccattctcaaggactccaaccgcattctgccggtttcgtcgctgctgagcgacttccatggcatttccgacgtgtgcatgtcggttcctacgttgctcaaccgcaacggcgtaaactcccgcatcaatacgccggtttccgaccgcgagcttgcagccctcaagcgctccgccgagacgctgcgtgagacggccgcccagttcggcttctgattcgcgatgatatgagtgccgccgattattcggcggcatttctttttctggcgtgtcacggatgcccggcgcatactggatacaccacttgacacgagaatatggggggagagatggcgcacgagcattcccacgcaccggtgaacggcaccgaagggcacttcaaacgactcatcgtcaccttggcgctgacggccacgatcctggtggccgaggtcgtgggtgctgcgctcaccggttccttggcgttgttggttgatgcggggcatatgaccaccgatgtcgccgtgctcaccgcatcgaccgtcacggccgcgctcatgcgtcgcaagcccgacaagtcgaagacgtggggctgggcccgtctggagatcatcaccgccgccggtggaggactggtgctcatgttcgtgggcctgtatgcgctcatcgaggcggtgctcaggctcaccggtgtggaatccgagtccgtgcacgatgttcggctgctgttgttcttcggcattctcggcttggcttcgaatatcggatccatgttcgtgctgcgagcacagtcgaatgacaacatgaacatgcgcgccgcgttcctcgaggtgtgcaatgatgcgctcggctcggttgcggtgatcatctcgagcattgtgctcatgtgcacgggttggagcggattcgacgccatcgccggcgcgctgattgcattgctgatgatcccgcgggcctacgggctgctccaccatgcgatgcgtgtgttgctcgaggagacgccggatggtctcgatctcgacacggtgcgcgagcacttgctgggcgtgccgcacgttctggccgtgcatgatctgcatgcgagcgtcgtctccaccggcatgcccattctcaccgcgcacgtcattgttgagccggatctgaccgtggcccaggcaggcgaggtgctcagacagctgcaggattgcacgcgacagcatttcccggtgtcgatcgcgcataccacattccagctggagccggaggggtattcgaacgtcgacgtggggcagatccatgaatgatcgccgccgtatgcagattggcggagcggttgccatgggcgtttcgtgacggacttgttgcataaacgaccatactttgatgaattatggtcgttgagtgatggatgcgttcgctgaacgaccatagttggcccgactatggtcgttttgtattggtcgcgtttgcctacggaccatattccacgagatgctgtgaccctatcggggcagccggggatggagtgctcccagatgtgggatggatggcgatgcgaggatggggaagagggtaagagggtaagagatatgaatgggaccctacggcaaaatgctttggggtcccatttaggtcaacacaggggtaagtctgtagtcgccggttccttccgacaatgttgatccgtcagattttgcgtagtacggtgacgaccttgcccatgatctgtgcatgggtgccgtcgatgggtgcgtagttcggattgtgggggatgagccaagtatgaccgtgctcctgccggaatgttttcacggtggcctcgtcgtcaagcagcgcggccacaatgtcgccgttctctgcattgtgctgttcgcgcacgaccacgaagtccccgtcgcatatggccgcgtcgatcatcgagtcgcctttgacctcgagcatgaacagattgccggttccggtgagacgcactggcagacgcatgacatcctccacatgctgctcggcggtgatcggctgccccgcggcgatggcgccgaccagggggacgtcgaggaagtcggatggttccaaatccatgccgtcgaagggaacgatgggattgccgccggatgtgccgtcctgtgtctcaacaagctcgatggcccggcctttattggggtcgcggcggatgaatcctttgctttccaatgcatggagctgatgctgcaccgatgatgtgctcttgaggttggcggctttgccgatttcccgcaacgacggcgcgaacccctgttcctccaagagcttgcggatggcatcgagtacctgtagctgccgtttcgtgagtgattccaggctcggtcggcttccggccggcgtgggtgcgtcgaggttgctcatgtcgtgtcctttcctatgtgcataccctaccgcgaaacgcctgaaaaatcaaacagatgttcgaacggattgacatcgtcgaacagatgtgcgaatatggactgcagctgttagaacatttgttcgaaggagtggtcatgcgttcgaagtcgattgtgcaggtgcaggcgaagacggtgagcgagcgatatcggaattccttccttcgcgcacatcaccgtgttcttgccgtggtggtgactatatcggcctgtttcgcgctgtgttgtgtgactgctggcgcgcgtgaaagcgatgctgttgtggaggcggcttcctcggaagtcgtgcactatacggtgcaacctggagattcgttgtggagcatcgcttcgagattccccggtgattcgtccagtgcctaccagcgggtggaacggctcaaacaggtgaacaatctgcgtgggggcagccttcgggcgggtcagcacctggtgattccgttgtgagtgctatgtcatcaggtgtcatatcatgacacgtcatgcgctaatatattcggggcaatgcgaacatgggccgtgggcgcggtattcttggagtatgcattgtcctttctgccagaatcccgataccaaggtgatcgatacccgaatcagcgacgacggccactcgattcgccggcgtcgtgaatgccccaattgcggtgcgcgcttcagtacgcttgaaaccacgatgctgttggtgaagaaacggtccggcaacgtcgaacagttcgacaggaacaaggtcattgccggtgttcgcaaagcatgtcagggcaggcccattcacgaggatgatctgaaacgactcggtcagcaggtggaggaggatctccgtgcccgtggcgtggcgcaggttccgtccgacgaggtgggcaaggcgattctgagaccgctgaaagatctcgacgaggtcgcctacttgcggtttgccagtgtgtaccagaacttcgaagatctcgaggatttccagcacgccatcgatgcactgagggattcggaataaatgctggtttccgcttgtccagccgggcaagcggaaaccagcatcagctgtgggtatcagctttcgatgacccgggtgcggatcgtgccggtgatggcgtccagcgcgtcgatggtgacctcgtcgggacacttggtcacatcggtcaccacatagccgatctcgccttcggttccgagcgcttgtgcgctgatgttgatgtcctgctcaccaagcacctggttcaccttggccagcacgcccggcaggttggcgtgcagatgggcgatgcgtgccgctcccttacagggaccggtggtgatttgcggcaggttcacggagagcatggttgatgccttgaaccaataatcctcaagcctttgggagacgaactgcgcgatgttctcctgcgcctccagcgtcgaaccgccgatgtgcggggtgaggatcatgttgtcctcatcggccagcggtgtggagaacgggtcgccggtcttcttcggttcgttctggaacacgtcaatggcggcccctgaaagatgccctgaatctaggtgctccttcagtgcatcgaggtcgacgacgaagcctcgggaggcgttgatgaagatggcgttctgcttcatctgcgagaattgcttctcgccgaagaagccggtgttcgacttgcggccgtccacgtggatggtcacggcgtctgcctcgttgagcagctcgtggagcgtttcgcatcgacgtgcattaccgagcgcgagtttctcctcgaggtcgtagaagatgacactcatgccgagcgcctcggcgagtaccgagagctgcgaaccgatgttgccgtagccgatgatgccgagggtcttgccgcgaacctcatgggagccggaagcagacttgtcccatacaccatgcttcatgtggtgtgtgtgggcggggatgcgtcgcatcaggcatatgatgtcgcagatcaccagttccaccacggaacgcgtgttcgaatatggtgcattgaatacagcgatgccgttcttggcggcatggttcaggtccacttggttcgtgccgatgcagaagcagccgatggcggtcaatgtggggcgtgcatcgatgaccgctcgggtcaccgtggtcttggaacgtacgccaagcacgtcgacaccctcgagcgcgtcgatgagttcccgttccgagagcgcacccttgcgggtctccacttcgaatccgtgggcgcgaaggctctccgcggcgagtggatgaatgttttccaacagtagagctttaggcatgcttcccaccttaaagggtcagtaggttttcatcttctcttgtccgtactataagcagacgctgggtcgggcgtgtcaacgccacatacagatcagccgccgcagccagacgacttggggcctcctgtgcaatcagtcccggctgggccacaatcaccgcatcgtattccaggcctttcaccgactgggcgtcgcagaccagcaactgggaatcctcgatgtgcatctgactggtgtcggcgatgcgcttgaacctccgtgagatggcactgcgggcggcgtctttgatttcctggggcacaatgacggccacacggccattgccgtcgctgtcaatgaattccttggcgagcgatgccgcgtggaagctcagttcgtcgtacatcgtcgtgtcgtcgtccaccaccagacgctgcaccgagtcgggaatcgagcgaatcgccttgactgtggaaatatagagtccttcgcgctcggcgaaagacgaggcgaggtttgagacctcctgcgggttgcggtagttgatcgtcagttcattgaggctccagttatgctcgccgaagagtggtgtcatcgtcttcttccagtcgcgcgtgccgccgagggccgaagtctgggcgacatcgcccacaatggtgaatgagcgtgaggggcaacggcgtatgagcatgcgccagtccatggcagtgagttcctgcgcctcatccaccacaatgtggccataggtccattcgcgatcggcggcagcacgttgcgccaccagttcggcatcgccgccgttcatatgatccaccagcatcttcgagttgacgatgcccgagccgatgccattctgcgccaaggtgtcggcggcgaagcgttcctcctcctcccgcttggcgttgcgcgccgcggcacgtgcagcatcgcgagggtcggggccgagcagttccatggcctcgtcgagcagcgggatgtcggaacgtgtaaatgcggcgccgcgttcacgcgtgagcatgcgtacctgcgcctcggtgagccaaggggcgtagcgcttgagttgcgcgggtttcgagagcatctggtcgagcatccatttggcgtccatgggaagccatgccaggttgagcgcgatgcggatgggatcggaaaggcgcagctggctcatgaagtcggagacctcagccgcctccggggtgtagtcgagctgttcgatgtactgggagcgcatgcgttcgagcatctcgttcacgaaggtctcacgcgctttgttgtgcggctgacgggtgcgtcgtgccgcagcgatggcttcggtgacgtcggctgccctcatggtgactggaatgccgttgaaatacacggtgggcagattggccggcacccgttcgcgcgccgccaccgcgttggcgattgcattggccatgcggcgttcgcctttgagctgtgccacatgcggttcgtcgtgacgctcggccaccatgcccggaatcagttcaccgatcgtgcggctcaccacgcccgtctctcccaacgacggcagcacctgatcgatatagtgcaggaactcctcgctggggccgaccacgagcactccggaacggtcgagcatacggcgatgcgtgtagagcaggtaggcggcgcgatgcagggccactgcggtcttgccggtgcccggtcctccctgaacaatgacggccccgcgcagtgccgcgcggatgatgcggtcctgctcgccttggatggtggccacgatgtcggtcatcttgccggtgcgtcgtgacccgagggaggccagaagggcgccctcgcccgtgagcgttccctgctcggacgcggtgttgacgtggggtgaatgcacgtcgagcacctcatcttcaatgcccacgacctcgcggaagtgcaacgtgatatggcgacgcatcacgatgtcgccatgatgcgacggagtcgcctcgtagaacggccgtgcagcctcggcgcgccaatccgtgagcattggctcatggttctcgtcggaaaggccgatgcgacctatgtagcgtcggttccccgactcgtcgtcaaggcgcccgaacaccagacggtcctcgacggcgcgcagctgggtgagccgatcctcgtacatggtggcgaaggagtcacgttcggtgcgttgcgtgggcgagccgtgggatccggccgcgcgcacgtcgctcaggcgttcgcgcgcctgtgtgcgaaggtcgtcgagcctgccgtaggcgcggtccactacctgttgttcttcctgaatctgcgaagagtactgtgacatgttcccgtacattccctagtctgactgaagccacactatcttaccaatcggcggctaccgtgggggcgtatgcccggaagaacaatccgtatggcatcgcaatgggcgaaatcaatctttccggattgcaatttgagtggaaaaaatgaattttcaggtattctatgcggttcttttcgagtgcctgaggcggtggacgccgctgtcagtgcgccatgagtggtgtcggaagcggagttttttgtgaagaaacgcgtgtttcgtcggttttgggtgtgtggtggggaatttaggtgagtggtggggtagagtggagagacgaagagttcgcatgcgtgttgataggaggagccatgaccgacgaaccagtcgagccggactcctccgcaccggtggttcctccgctgttactcggcacgtacaacccgaagatcgacgccaaagggcgcatggccatcccggcgaagatgcgtgcgcagctcggtgagggcatggtcatggcgcgcgggcaggaacgctgcgtatatctgctgccgcagtctgagttccgccgcatcgccgcacagattcagcgcgtctcggtgggcaacaaggcggcacgtcagtatctgcgcgtgtttctcagcggcgcggttgatcaggacaccgacaagcaggggcgtgtggtggtgccgcagatgctgcgcgagtatgcggatctcggtgacgacattgtggtgatcggcgtgggtacgcgcgccgagatatggaacaggaaggcgtgggagcagtatttgagtgacaacgagccggaatattcggacattgccgacgatgtgctgccggacttggagttctgatgaccgatttctcgcagattcacaagccggtgcttcttcaggagtgcgttgatctcgtcactcccgctttgcatgcctcggattccgtcgccgtggactgcacgctcgggctggccgggcatacgattgcgttcctcaaggccgccccgaacgccacggtgatcggcatagaccgtgacgaggaggcattggacaaggccaccgcacgcattgcccaggaggggttgtccgcacgattcgttccggtgcacgccgctttcgaccagtttgacgaggtgttgcgtgcacagggggtgagccgggtgcaggccgtgttcatggacctgggattgtcgagtctgcagattgatgaacgcgaacgtgggttctcgtatgcgcatgatgcgccgctcgacatgcgcatggacacctctcaggcgttgacggcccgcgagattctcgcgacctacgacgcggaccggcttgcgcatatattcaaggagtatggcgaggagcgcttcagcaagccgatagccaagcgcatcgtacagcagcgccagagcagtcccctcgagacctcgagccagctcaccgccttggtcgatgcagtgattccggccgccaggcgtggtagcggcaatccggccaaacgtgtgttccaggcactgcgcatcgaagtgaatggagaactcgacaagcttcggcgaacactgcctcagattgggctccatcttgctgtcggcggtcgcttggttgtggagtcgtaccattcgctggaagatcgcacggtgaagaatttcatggcgcaggggttgcgggttgacgccccggcagatatgccggtgattccgccggacatgcagcctttcttcaaggcgctcaccaagggagcggtgaaagccgatgccggcgagatcgcgtacaatccgcgcagcgcgtccgtaagattgcgcgcggtcgagcttacgcgtccgctgccgcagcgttgggtccatgccttcgaactggaatctcaagggtcggaggacggtgtccgcggagcacatggccaccggcgccgtacccaggcgaggaggggataacatggcggttccaatgcgatcgacacgttcgaatgtgtcacctgcgggcaggcagtcagatccggcactcaagcgcccgcatctgcacgtggtggagtccggagagcaccatgccaaggagacggggcatggcgctcatgtggccagcaccgtcatcgcgtggacgcgtagccgcccgcgcccatggctgcacaccaccattgcgattctgtttctggtgctgtgctggatcggcacgttgatgctgcgcacccagatggtggagaactccttcgaatcgtcgcaagtggagcagaacatcacgatgcttcggcaggatgtggaagataatcaggcgaagctctcgaacctggaggccacgttgccggatcgtgcgcagaaactcaatatggtgcctgcctcgggatccctcacgatagatctcaatggctaccagccgccaaaggatgagaaggcgacaacaggggaatcagccgagcagcaggcgacgtcaaaccagcatgacaccagtcagggaggtgccaccgaatgaaaggcctgaaagccaaatggaatggcgcctcgcagttgatgcgccgcaccatcgtcatcacggtggtgatggcggtgctggccgtgtgctgccttggcaagctggtgtacattcagctcatcgaaggcccgcaattggccatggccgcccagcagagccgtacgctcaaggtgacgttgcaggccaagcgtggcaagatcatggacacgaacggcgtggtgctggcccaaagcgtggagcgctacacgatcataggcaatccggatgcggcgcagaccttcgaaccgacggcatgtacggcagcgaccaagccgtattgccagcagctcgacggcaagccgctgaccaccacaggtgtggccgcggtctcccagctgctcgccccgctgcttggcatgagcgcctcggagataggcggcaagctgtcgggcacaggccagtacgccgtactgaagaaagacgtgacgcccgaggtcaaacgcaagatttcgcagctgtacttgggaggcattgtctattcggagctgagcaatgaacgcctgtactcgaacggcacgctcatgggagcgttgcttgggggcgtcaatgccgagggcgagggggtcgccggcatcgaacagctgcagaacaagacactcaccggcaccgacggctatcaggtgtaccagcaaggtaacggcggtgaggagatccccggcacgatgaccgactcgaaggaggcggtggatggctcgaatgtgacgctgaccatcgatcgtgacgtgcaatggcgtgtggagaagattctcgccgatgcacaggagaagtacaaggcgcgctggggcattggcgtggtggaggacgttcgcaccggggagatcattgccctggccgacaccgacaagatcgaggccggatccggcgatgccaaggtgcaggtggcgcgaagcgtcaatcaggtgttcgagcccggctccattggcaaggtgttcaccatgggcggtctgttgcaggagaagctgcaccatatgggtgaccgtttcaccgtgcctgacagcatcacgctggagggtcagacctacaaggattcgttcaaccatggcgccgagcgttggacgctggccggtgtgctcgagcaatcctcgaatgtgggcaccatccaggcctccgacaatttccccgacgacaagcgctacgagtatctgtcgaaattcggcataggccaaccctcctccctgcaccttcccggtgaatcgcagggcgtgctcacgccggcgaacgcatgggacggccgtacccgcaataccgtgctgttcggtcagggctactccacgaacgcgctgcagctgaccaacgccatagccgtcgtggcgaacaagggcgtgatgaagccccagagcatcatcaaatcggtcacggcctccaacgggcgcgaggagaaggtcaaccccggcgaatccaaacgcgtcgtcgatgaaagcgtggcgaatgagctgctcaacgccatggaatcggtggcggagcactaccagaagttcgccggcgtgagcggctaccgtgtcgcctcgaagtccggaaccgccgagatcgtcggcgatgacggcaagctgtcatcgctgatcagcgactacacggccatcatcccagccgacaacccacgctatgtggtcaccgtggtgcttcgagacccggaaggcaactatggcggtctgaccgccggcccggtcaccgcggagataggccagttcctcatgcagaagtatgaagtgccggcatccacgccgcgcaaggacgccatcccggtggaatggtgaggcaaggagttcatatgagttcactgagcgaagcggccacgcaccgcaccacattgggcatgcttgcagaccggtacgggtacgagctctcgccgaagttctcccgcgcggtcaccgtcacgtcactggccagcgacatcgattcggtgaccgccggatcgttgtttatgccgggcaaacgcatcgatgccgccagggtggccgccgcctcacggaaaggcgcctatgcggtgatgctcccgaagtcgatgagatcgagcgatctggaagccgacatccctttggtgtacgccgacccgaccccacgcgagataggccagatcgcatcgaatatgaccgggaatccggcgggaactttggcggtgttcgccatcgccgggatcaacgatgaccagatccatgccaatgtggagatgctctcccagttcctgcacatgctcggcaatccagtgggcacaatctgcgccggcgactcgcagtcgttggaccgattcctcgatttgaggtacccgatggatattctctccatgcagcgggtgctctcggtatgcgccgaggatggcgccgccgcggtgattctcgccttggacgacaacacgttgcagcccgacgccctgcaatcggtgggggccgatgtgatcggctatgacggtgtggccaaccccatggcagggcaggacttagtggaacaggcctgcgaacggtatggctgcggcattgatgaaggcacgcatatcgccttccgcaccgatgagaccgatcagatggccgtgcaagcggatttcgggctcgacaaggtgaggtcgctgtcgctggcgattgccatggtgatggctgcaggcgtgaagaaagcgaacattcgcagcgctctgcgggtgtcgagggaactgcactgagcgcaggatttttcgaaaggaacggtgaggaacagacatgatgcgaatgacgttggcgcagatggtgcaagccgtgcatggctctgcggagcattgcgactgcgatgacctggagacggtgaccgccacgagcgtggtgaccgattcacggcaggtcgtagacggggcgctgttcgtggcgattgccggcgagcatgtggatggccatgatttcgtggatgcggcggcacggcaaggcgccgcggcggcgctggtggagcgtgagatcaagtcggctcccatcgcgcagattgtggttcccgatacggtggcggcgttgggggcgttggccaaagccaatctcgaggcgcgcaaggccatcgatgagcccttcacgatcatcggcatcaccggttcggtgggcaagactaccacgaaggacctgctccatgcgttgctgagcacgcaaggcgagaccgtggcaccgaagggatcgttcaacaatgagatcgggctgcctttgacggcactgaaggtgggggaacgcacgcgatacctggtggctgagatgggggccaaccacatcggtgagatcgccaggctcacgaagatcgcaccgcctgacatcgctgtagtgctcaaggtgggcgtcgcccatttgggtgaattcggttcggtggaacgcatcgcccaggcaaagagcgagatcgtacgtggggaggcgccgaatgcgatcacggtgctcaatgcagacgatgagcgtgtggcggcgatgagcgggattgccaagggcgatgtgttctggttcggcatcgacaaggcgcaggcacatgatatcgacggctatatggctgccgacgacattgcattggacgatctggggcatcccgtgttcgaactcgtgtcctcgcagggagtggagcagcgtgtgtcgctcggcatcggcggccgccacaacgtgatgaatgcgttggccgcggcgagcgtggccaagctgctgggcatgccgctcgaacgcattgcccaggtgttggcggatacccgcaggatcagcccgcatcgcatggcggtgagtgaggtggagcgggatggtgcacgattcacactcatcgacgattccttcaacgcgaatccggactccatgcgcgcgggaatcgatggcctcatggcatggcgtagccaggaggatcagcagccttaccgtgtggccgtgctcggctcgatgcttgagctcggctccgatgagcataacctgcacaggacgattggcgcctacgcgctcgatggcggtgtggatgcgctgatctgcgtgggtggcggcgatgacgcctcactcaacgcgttggcgcaggacattgcggatggcggcaccgaggcgaaggatgcagacgacatgcgaccggttcgggcggtgaagaccactcagcaggccgatgatctgattcgcgcactcaacgccgaacaccccgacatgctggtgctgctcaaagggtcccacgcctcaggtctgagcgcgttggcgacacagtgggccgccgaggccgaataacacggaacccaacaactacaaggcaacaacacccacgaatggagtaacctcgtgatcgccctcatcataggaattctgacgtcgctgatcatcacgctcgtcggtacccctttgctgatccgcattgtgcacaagctcaattacggtcagtacatccgccaggacggccccaagtcgcatcaggtcaaacgcggcacgccaacgctcggcggcgtggtcatcgtgctggccgtggtgctcggctggtgtgcctctgccctgtaccgtttctgcacgacgggggcacggcccacttgggcggccattctcgcactgttcgccatggtttcgatgggtgtcctcggcttcatcgacgatttcgccaaggtacgcaagaagcaaaacgagggcctgacggtgggaggcaagttcttcggtcaggtcgtcttcgccaccatattcgcggtgcttgcgctcattgttcccacccggtcgggattcccagtggcacaggcaggcatgagcttcatagagaagccattcctgagcttcgagttcgctggtaggattgtggcgatcattctgttcgtgatctgggtgaacttcctcatggccgcctggaccaatgcggtgaacctcagcgacggcctcgacggcctgtgcgccggttcctccatgatcgccttcgtggggtatgcgatcatcgccatgtggcagatgtaccatctcaaggggcaggcccattccggcttcacctatgccgtctccgacccgctcgacttgggcatcatcgcatgctgcgcggccgtggcctgcctgggcttcctgtggtacaactgcaatccggcctccattttcatgggcgacaccggctccctggcattgggcggcttgttcgccgcactctcgatcatcacccacacggagttcctcgccatgatcatcggcggtctgttcgtggtggagactctgagcgacgtcattcaggtgggctatttcaaggcgacgcacaagcgagtattcaaaatggcgccgatccaccatcatttcgaattgtgcggctggagcgagagcaaggtggtcgtgcgcttctggatcgtcgagctcatgttcgtcattaccgggctcatcatcttctacggcaactgggtggggctgtcggggctctggcatcactgatcgcaagcttgcggcgtagcgggcgatgtggccgaaacaccgcggcggtataggtagagggacatacatgaggcattccagcaagacatgcgaggtgggaaatgagtaatcaggaattcaacgcggcgggcaaatgcgtggtggtggcaggtctgggcatctccggacgcagcatggcgaagattctgcgtgatgccggcgccacggtgatcggggtcgatgagaagctggaggcggccgacctgcattccttcgacgacattgactgggatgaggtcgatctggtatgtacgtcgccggtgttcaacccgcgcacgccgttcattgtggaggcgcaaagccgcggcattgaggtgatctccgaggtggagctcgcctggcgcatgcgagtgcccagcgaacgcaccggttcgcccgctccgtggattggcatcaccggcacgaacggcaagacctcgaccaccgaaatgacgtcggagatgctcaaggcgtgcgggtatacggcacctgccgtgggtaacataggcaacgcgctctccgccgccgcactcgacccggtcaatgacgtgctctgtgtggagctgagctccttccagctgcacttcacctattcgctagagctcgattgcgcggcgatcacgaacatcgccgcggaccacttggactggcatggcggtatggcgaactatgccaccgacaaatccaaggtgttcgatggcgcgaaacgggtcatcgcctataacgcgcaggatgcccgggtgagcgagctggcacgtaccgcgcagaccgccgagggctgcgaacacatcggcttcacgttgggggagccggtttcggggcagattggcatcaaggacggctggatcgtcgacatgagcggcctatgtggtggccagaccggcgaggcatatgcgctggcgccgattgcggacttcacgcatctcgccgaacccgatggtacaatctacccgcatctgctcgccgacgccctgaccgcgttgattctggtggtgggtctcggcgcagacgtcgccactgcgctcaacgcgctcaagcgattcgcaccgggaggccatcgcattcagacggtggctgaactcgcttcgccggaagggaccattcgcttcgtcgacgattcgaaggccacgaatgcgcatgcggcccgtgcctcgctgaacagcttcgcgcccggttcggtggtgtggattgccggcggcctctccaaaggtgccaccttcgaagagctggtggagcaggagcggaatcgtctcaaggcggtcgtggtgattggcatcgaccagaaaccgatgctcgaggcattgaaagccaaagcgccggagctgccgttgacggtgattgacccagccgacaacgccacggtgatggaacgtgccatcgatgccgcggcggacttcgccgagccgggcgatgtggtgctgctggcaccggcctgcgcctcgatggatcaattcaaatcctatgccgatcgcggtgaccagttcgccgcccaggcgaaacggtgggtgaatggacatgccgaagcctgaacgtcaacctcgttcgatgcgttcggcgcaggacggcaaatcgagcggcgccattccctcggtgaagccgctggtgcgccgaagccgtcggagcggtgcgccccaaccatggaccgtcacccacgacgaccctgccacagcagcacgaatcgcctccaaacgtccgtcaccacagttcggcatgattgactttgccggcgaatacaaagggtggcgtgtgctgctcaacccattgggctgctactatggattcatcgtcgcagtgggcattctcacggtgttcggcatcatcatggtgttctcgagctcgtcggtcgacatggttgccgcaggttcctcgccgtgggcgaaggccctcaaccaggtgggcttcagcgtggtgggcctggtgctcgcgttggttgcagcacactgcaaggggcgtacgctgaagtggctggccctgccgatgtacttggtcagtgtggcagttcaggtgttcacgttcttcttcggcatcgacgttggcggcaaccgcggctggctgcgtatcgcaggcatccagttccaacccgccgagttcatgaagttcacgatctgcctgtggttcccactagtcatgatttcgatgatgcgtctgaaaccggggatacggcagtcgtggaaggcgtgggacctcggtgactgggggcgaacctttggcctatatgtgcttggtttggggtcggtgcttttgggcaaggacctcggtaccgcattggtaattatcctcataggactcatggccattgtggccagcggattccccatgaagtacgtgggtctggtgggtattgcggccgtggtgggcgtggcgatccttacggtgttcagctccaaccgcatgtcacgcatcatggcgacctatacgggctgcaccgccgataacatcgacgtatgctaccaagccacccactcgaactacgcgttggcctccggcggtctgctgggtgtggggctcggcaattcccgcgagaagtggaactacctgcctgccgcgcataacgacttcatcttcgccatcattggcgaggagacgggttttgtgggtgccgcactggtggtgctgctcttcgtggtcatcgcctggtgtctggtggcggtggccatgcagatgcacaataggtatgccagcgtcgcattgctgtgcttcatgatgtggatcgtcggtcaggcgctcatcaacattgccgtcgtcgtggagattcttcccgtgatgggtgttccgttgccgttcgtctcggccggcggttcgtcgatgatcttctgtctgatggccgcaggggcatgcgtctcgttgatgcgcgcccagccgcagatcggggcggcgcattcgcgcgcatagcattcgccgtttcgcaatccgtcatatgagagcacaatcaagtacagtggagatatgagttcgaacacacagcaccgcatcatgcttgcgggtggtggcaccgcaggccacgtcaatccgttgctcgccgtggccgacgcgattcggtgcctcgaccccgacgccgacatcatcgcgttgggaacggccgtggggctggaggccgatctggtgccacaggccgggtaccaactggagacgatagagaaggtgccgttcccccgcagacccaaccgtgcggcgttggaattcccccgcaaatggaaggctgagaaggccaaggtgatgcagtaccttgagcaccagggcacccaggtggtcgtcggcttcggtggctatgcctctgcgccggcctattccgccgcacacaggctcgggattccggtcgtgatccatgagcagaatgcccgtgcaggcatggccaacaagctcggcgcccgttgggcgcagttcattggcaccgcctacgacgcaaccgggctcaagcccgcaaaggatggcggaatcgagcgtgtgggactgccattgcgacctgccatagcgaatctcgccgaggaactggaacgcgacagggaaggcgcccgaacccgcaatgccgccgaactcggtcttgacccgaatcggccgattatcgtggtcaccggcggttcgctgggcgcgcagagcatcaaccgcgccgttgccggcagtgccaggcagctcaccgaagtggcgcaaatcgtgcatctgacaggaaaaggcaagatcgacgaggtgcgtgatctggtggtgcagaacgccggagccgatgtgctcaccggtctgggtgaggaaagccggcccgggcgcaactaccacgtcgcgcagtacttggagcgcatagacaaggcgttcgcctgtgccgacctggtgatctgcaggtccggtgccggtacggtgagcgagctgacggcgctcgggttgccggcggtgtatgtgccgcttcccattggcaacggcgagcaacggttcaatgcgcttccggtgagcgacgcaggtggcggcatcattgtggacgacagatcgttcacctcgcagtgggtgtccgcgcaagtgcccggattgctggcgaatccggcccgcttgcgctcatatggtgagcatgcgtggcagtatggcattcgtgatgcggcggaccgtatggcccgtgagatcctttccatcgccgatgcgcgagtctgaagccatgctgcatgggacagcggaacacagagcaaggagcttgaaggtgaaggaatccattgtgcttgatccgaccgtggcacagttcggcgaagacctgcgtgccgcagatctgggcaacacgcatttcattggcataggtggtgccggtatgagcgtgctcgccgagatgctgcatgagcagggagtgccggtcgacggttcggaccgcgaaccgggcgcgaaaaccgagcggttggaatcactcggcataccggtgcaattcacccaacgcgccgagaacgtgcaggatgcgcaggtggtggtgtattccagcgcgatcaagccggacaatcctgagatcgtcgcagccgtggccaatggcgcccaattggtgcatcgcagtgacattctcgccctgctcatgaacggcaagcacgctgtgaccgtcgccggcgcccatggcaagacgaccacgagctcgctgctcgcccacatactcatgcatgccggcaccggcgaactcgccgacccgagctatgcgatcggcggctccattcagggacccgacggaaccacgctcgatgggggacatgccggcaaggggacggtgctcgtcgccgaagccgatgaatctgacggcagctttgccaaataccaccccgacatcgagattatcacgaatgccgaggccgaccatctcgaccactaccacacggaggagaactatcacgcggcattcgccgaccacgttacgcatgcccgccgcgcggtgatcatgtgcgtcgacgatgccggggcgcttgccgtgctccgctcgctcgccccagaggacgcacgcaaggtgatcgcctattccacccacaccgccgacgagctcggcgacctcaacggcgccaccttcgtgcacatcgcctccgaacacgagtccgcgaacagcggcaccgagaacttcgtgatcgacattcccgccgcgcttgtcggtgccgacgtcgcattgccggtgagcttgaggatccccggcctgcacaacgcccgcaacgccacggcagccattcttgccgccgttctgctgggtatggatgccgaacgcgcggcggtcgcggctggcaccttcctcggtgcgaaccgccgattccagattcgcggcacggtgagcgacatcaccgtggtggacgattacgcacaccatccgaccgagatcacggcgctgctcaaggccgcgcgcagacgctaccccgattcgcagctgcacgtgctgttccaaccgcatctcttctcacgcacacagttcttcgcacaggagttcgccgatgcgctctcactggcggacgatgtgattgtgaccggcatattcccggcgcgtgagaagcagtctgatttcccgcaggtgactccgaacacgattgtggacaatgcgcatggtgacggttcgtatgagatcgaggcggtggacgatatgagtctcgccgcccagatgctcgctatgcgcgcgcagccgggagatgtgatcttcacagtgggcgccggtgacatcacgaggatggggccggtgatcctgcatgtgctcgaagcgcattacggtaacgcccagcaggactgagcggctgaagaacacggcataggaaggcgatatggcaagacgtacggtgagctcctccggtcattccccggactcgcagcggcaggaaccgcagtggccgcgcggccggtcggtcaggtccgctgggtcggggaaccgagccgtccgctcgcgccgtgatatgccggaatcgcccacccgagacaataccgcagccgtgcgggacgatgagcagccgcccacccaatcgcagtcgttcgaagagtacccgaaggcgatgcgaggcaggcaggcacgttccggccgttcggcaaaagccgcgcgatcggtgcgcgccggcaaggaaagacgtgtgcgtggcggccagtcacgaaccgttgagccccgtacagccacgtccggaacccacgatgccgaacggcaatctgccagcggggaatccacgcaggtgtcatctggtccgaatgattcggccaaacgcccacggtaccgcttccgcaaactcgtgcgcaaacgcaggcgcgaatcggaacgcacggcgcgcaccgcacagtcctcgcagtcaaaggccgtctccgcgcccggttcgttcgtcgatgcacgggcgctggaaagcgaggatctggtcgcgcgcacgctcgatgagtccgccggtacgatcggcgtcgccacccggccaaaagtcgtggatttcaaggagcgccaacgagaacgtaaaaccgcgaatctgcgcgtgctcgccatgcgtataggcattggcgcggtcgtcttcgcgctggtcatcgcgttgatctggctgctgttcttctcgccggcgctgagattgcggcaagacaggatcacggtgatgggcgcgaatgagtgggtgaaccgcacgcagatcctcgacatagccaaacagcaggccggcaaatcgctgctcatcgtctccgacaagtcggtggaacaacagctcgatgacatcccgggcgtctcctcgtcccgcgccacgaagaaattcccgaacggactcgaggtggaggtgaccgcgcaacgaccggcggcaatgctcaaagttgcaggcaaggacggtctgacggcggtcgataaccagacgcgtgtgctcaattccgtgaccaatcaggcagtcaagggcattccggtgatcgaggtgaagaacatcgacgacgcactcggccagcgatcggtgcgcgccgccgtgacgattctcgacgcgatgccggaatcctggcgcacccgagtgaccgcggtgagcgcgaacacgcaggactcggtgacgaccacactcgacaacggcatcaccatcgtgtggggcgacagcgcggaactgaaactcaagatggcgattgtcgacaagatcatgaacgacccgaatgtgatcggcgacaagaaacagatcaacgtctccgcgccgggaaggccgatcatcaaataacgaagccgggggaaagtgtggccccgggcaaatctcagcatacgaaactgcccggaaacaccccggaaatcaaaaaagcgctgtattgcaatgcttttgcctccagcatacctattcatgcgcatacgtatgctgaggcgaaacgtgcaggtaatgcgtgaagctgacaatctgcttggtaattgttccgtgagagagtggagcaattccagaagagagagggttcggtgtgaacgcaaagaagatcatcgccgccattgcatcggtggccgcgctcgccctcggtgagcgcctgcggcggcgtgaaggacgacgccgccaatgccgcgggtgagaacagtgtgcttgtcggcaccaccgacaaggtgacatcgctcgacccggccggttcgtacgacaacggttcctatgccgtgcagattcaggtgttccccttcctgtacgcacaggattacaacacctccgagctttcgccggacatcgcagccgacgacggcacgtggagcaaggacggcaagcagttcaccgtcaagatcaaggacggcctcaagttcgcgaacggtcacacgctcgactcgaaggacgtgaagttctcgtatgaccgcatcgacacgatcaacgacccgaacggaccgagctcgctgctcgccaacatcgattcgattgaaaccccggacgccaacaccgtcgtgttcaattcgaaggtgccgttcgacgtcacgctcaagcaggtcatgagctcgccggcaggccccatcgtcgacgacgaggtgttctcggcagacaaaatcaccgatgccgacacgatcgtgagcggcaaggcattcgccggcccctatcagatcgactcgttcaagctcaacgaggccgtgagctattcgaagaacggcaactaccaggggctgacgccggtgaagaactccggtgtgcaggtgaagtacttcgccgatgcctccaatctgaagatggccgtggagcaggggcaggtcgatgtggcctaccgctcgctttcgcccacccacatcgaggaccttggcaagaacagcaaggtgaaggtcgtcaagggcccgggcggtgaggtgcgcatgctcgccttcaacttcaagctccagccgtacggcgaatcgcagaaggacgccgacgccgccaaggccaaggccgtgcgccaggccgtcgccagcctcatcgaccgcgacgagctctcgcagaaggtgtacaagggcacctacaccccgctctattccttcattcccgatggtctgaccggccatgaacacgctcaaggcctacacggacaacggcaagccggacgccgccaaggccaagaagacgctctcggacgccggcgtggccaccccggtggatctcaagctccagtacaacggcgaccattacggttccagctcggccgacgaatacgccgccatcaagagccagctcgaggccgacggcctgttcaaggtcgacctgcagcagaccgaatggacgcagtacaacaaggagcgtgtggtcaccgacgactccgacggtagctacccggtgtaccagctcggctggttcccggactactccgaccccgacaattacctttccccgttcttccgcgacggcaacttcgtgaacaacggctactccaacaagaaggtcaacgacgccattgtggcgcaggccggcgagaaggacgaagccaagcgcgagggcatgctcaaggacattcagaagaccgagaccgacgacctctccacgctccccatgctgcagggcaaccaggtggcggtcaccggcagcaacgtctccggtgtcgtgctcgacccctcgttccgtttccgctacgcctccgtggtgaagaactgaggtccttcgcataggtcagcctggtgcgttctttccgggacgcaccaggcattgactgttcccggcccgttgtccagttcattcccgcattattccaaggagatccggtgtctcaagcaatagcatcgccggcggattccgcaccatcgaaaccaaccgcgcataaaaacagactttccgcaggattcttccgcttcattctcggtcgcttcctgctcattatccccaccgtgttcattctcgtcacgatcgtgttcttcgtgatgcgtgccaccggcgatccgatctcggccccgatgggcggcagactcacacccgaggaactgcagcgccgcattcacggggccggctatgaccgcccgctcatcgtgcagtactttgattacctgggcggcttgctgcatggcgacctcggccgtaccctcaccgacaaccagccggtgatctcggtgctcacacggtatggcgccgccacgctcgaactggcgttgctctcgctcgtcgtggcattgctcgtcggcatcggcttcggacgcatcgccgccaagcaccgcgatcgtgcgcaggatgccggcattcgcatgttcgccattctgtgctatgcgacgccggtgttcttcctcggtttggtgctcaaactcatcttctcggtgggactcggtgttcttccgagctccggacgctcctcgctgcaatcggagatgcagttctccagattggtctcacccaccgggctgtatattgtcgacgcattgcaacccggcgacatgaaggtgctcggcgacgtgctcatgcatgcgattctgccggcgctggccttgggattgctcacggcgggcgtgttcattcgactggtgcgcacgaatgtgatctccacctacaatgccggctacatcgaggccgcccgttcccgcggcgtttccgagaagcgcctgatgtcgaagcacgcctggcgcccggcgctgatcccgatcatcacggtgatgggcatgcagatcgcattgctgctcgcgggcgcggtgctcaccgagaccacgttcgaatggaagggcttgggattcatgctctccaattatttgaaggcacgtgatttcgtggcggtgcagggcattgtgatcctgattgcgatcatcgtctccgtggtcaacttcatcgtcgacgtgatcagcgcgttgatcgatccgcgagtgcggtactgaaatgagtgaaagcacggaaaccagagtcggcgtgccgggtgacgcgcgtctggagaatcccaacatagagaagccgcagtcatggttcgcgaaactgcctgtggtgcgcgatctgaaaattgccgtcggttggcagaagggcatgcttgtcaccggtctggtgctgacggggttcttcctgctcgtggcggtgttcgcgccgtggatcgcgccatatggatatgcgcagatcaagggtgacgacggtgttgcgttcccgacgcaggccgcgccgtcacgcgagcatatctggggcaccacggtgggtggattcgacgtgttcagccgcacggtatggggcgcgcgcaccgccgtcatcgccattgtggtggctgtgctgctctccattttcgcgggcgtgttcctggggcttgtctccgggtatttcggcggatgggtggatcgcgtgttcgttgtgatcgccgacgccgtctactcgttcccgtcgctgctgctggcgattctcatggccattatgatctcgggcggtcagtcgagtctgtggggcggcattctcgcatccggcatctcgatcaccgtcgtgtacattccgcagtacttccgcacgatccgtgccgaggtgattcgcatcaaggattccgcgtacattgaatccgccaaggtcgtgggcgcctccacctggcgcatcatgagcaagcacctgctcaagaactccacgcgtacgttgccggtgatcctcaccctcaactcgtcggaggcgattctcacgcttgccggcctgggctttcttggcttcggcatcgaaccgacggcagccgcggaatggggctacgacctcaaccgttccgttgccgatgtgacctccggcatttggtggaccgccgtgttccccggtctggccatcgtgctcattgtgctcggcatcacgctgatcggcgagtcgctcaacgacttggcagatccgcgactgcgtgcgcgcaagtccgccggcgaagtggtcggttcaatcgaagacacctcggtggattcgcctgactctgggcctatctcacaggccgttgtggaacaggagtacgcggccatcaaagatgccaccgagaagcctgccgatctgggtgaggacgtgaacgaatacctcgtgacgcaggatccggagacggccgtggtgaacaaagacgtgccggatgagagcgagggagtgatcgacaatgagcgatgagttggaacgcactgggtcgatgggagacaatctggtcgacatcaagggtctgagcgtctcgttcgtgacggacgcgggcccgatcaaggcaatcgacggtgtcgatttcaccattccccgcaagaccgtggtgggcgtggtcggcgaatccggctccggcaaatcggtgaccgcccgctcgatcatcaagctgctgcccgagacggccaccactggcggtgcgatctacattcgcaccgcacaggatggggccgagggcttcgatgtgctcaccatgagcggcaaggacctgcagcaggtgcgcggtggcgctgcggccatggtgctccaggagccgaactcggtgctcaacccggtctatacgatcggccggcagatcgaggagggtctgcgcgcgcacggtttgaccgacaagaagcaattgcgggcgaaatcaatcgagattctcgagaaggttggcattccggacgccgccacgcgcatcgactactatccgcatcagttctcgggcggccagaagcagcgcatcgtcatcgcgatggccctcgtgctcaatcccggactcattctcgccgatgagccgacgacggcactcgacgtgacggtgcaggccgagatcctcgatctgctgcgtctcgcccgcgacgaattcggtgcctcggtgctcatcatcacgcacaacatgggcgtcgtggccgacctcgccgatcaggtggtcgtcatgtatcgcggccatgtggtcgagcatgggagcgtggaacagatcttctacaatccgcaggccgattacacgaagcgcctgctggcagccgtgccacgcatcggacagcagctcatggtgcgcgatgccgccgggcatgtgatcgagcgcagtgtcgattggcgtgaggaaccggtggtggtcaaggccgagcatatggacatcacctatccggggcagatgcagccggatttcaaggcagtggacgatgtgagcttcgaaattcacaaatccgaggtgctgggattggtgggcgagtccggttcgggcaaatcgaccacaggccgcgccatcgccggcttgcagcgcatttccgctggttcgctcaatgtgctgggcatggagatgcgtgatttcaaggaacgcaagttcaagccgctacgcgagcagatcggcttcgtgttccaggacccgggcagctcctttgacccgctcatgacgattctcgagaatgtggccgagccgctcattgtgcacggccggtacaagacggtctcgcaggcgaaacagtatgtgggggagctgctcgagatggtgcagctgccgcgtgcatatatgaaccgcttcccgcacgagctctccggcggccagcgccagcgtgcgtcgctggcccgtgcgcttgcgctcaaaccgagtctgctcattgccgacgagccgacttcggcgctcgatgtgtcggtgcaggcgaaggtgctcgagctgttcaagacgctgcaggcggagatcggcttcgcgtgcctgttcatcacgcacgatcttgccgtggtggacatgcttgccgaccgcatcatggtgatgcacaagggccgtattgtcgagcacggcgacgcctcgcagatcatgcaacacccgagcgatccgtatacgcgtaagctgctggcgtcgctgcctgttccggatccccgcgagcaggccgcacatcgcgaggagctgcgcaagctgctcgccgaggaggcctagggaatctgcaaataatggggcgcccgcttcgcatgtgtgggagcgggcgccccatacgcatacatcggaatattgcgagtgcgttcgtgttgtgctatattggaaagtccggctaggcgagagctacgccggtgagtttgataattcaaaaggggccgattggtttcgacggtgatctgttcgccttggagaagcatgccgagaatgcagggtccactcgtgatgttctctgcaataaaaataagtgctaaatctaatcgcactgagttcgctctcgctgcctgattttaaacgtaatcagatttaatccagcgagttagcactccatctgctctcccgcgtcttcggggagaggtcaggtgtcgttaggagactgacttgtgagattgaactgcagggtctcgcaaggacattttgctgtggctaggctcgccgccagttgtctgcggcattggcgggggccgaaaatacgctcgttcgagtcagcagactaagcatgtagaaggacgagggtacggtcaccggaccggggttcaatcccccgcggctccactttttcagaacccgccagaaatggcgggttttcgtttatttccaagggttttcgggccccgtggatataggtgtaaatgggttaaaatggacgcattccaatatgaaacgtgtccaaaatgaggccaaaaagcacaggggcggtgcaggcgctcaagcccacaaccgccccacatgccctgcacaccgctacaggttgtccacgattgggttcaggtagtcgccggtcagtagcacacgatcccggattatgatcgtacgctccgggtcgtccctgttcaccggatcataagggcctgcatcgggtttcacgcgggtagcgtaccgcgcataggcgggttgcgtgtaatccgcccccgcattgccctcaagcacctgcgtgttcctgtaccgtggctccctgtcgctcatggcgtgccccctcacttcgtcggcgtggacttcgctgcggccttggtggcgaacttcacgataccgtgcggcttgagcacatcgaagctgaaacggccctcgacacgggagatgacggtgttcgtccggaaaccctcgctcgtgttcgtcgccgtctcaaggttgccgtccgtcatgatctgcacggtgttcgtgccgatcgcatacccggtgccggactcaagataggcgtcggcaaccaccggcacaccccacaattgcttgttctgcacgtccacgatcggatcgttgatgtaatggccgagcgtgtccttggtggtggcgatctccacccagtccactgcgggaagcacgaacatggcgcaggtgatgccgtactgttcgatctgcgcggccgcgttgatggcggtggtcacggcgtccgagctgaacgcctgcgacttgatgccctcgacatggttcaggccgagcaggtggcccgcagtgccgtcgccgttgatgatctcgttctcgaacgtgcgcatgatctcacgggtgaggcgttcgcccacataatccacgacgccctgagacgactgccatgtgtacttgtccacagggtcggacacgacggcgatcaccttgagctggttgcgtaccttcttgaggccgagcttgaacgttggcttcgtctcgcccttctccacgaccgctgcggttcccgcgtcctcctgcgtggtttccatgagatagtcatattcgtctgtatgcaccactccggcaggaatgtagttgacgatgccgatgggcatctcgccgccctgatcgtggatcggaatggagttgacgatcggcgtgggcgtgaacatggccccggtgatcgacgccatgtcgatgcccttgacatggcgttcgttgatgtccttgcgcatggtttcgggaatgctcttggtgagcttggagaggtcgaggtagctcttggtgctatacggggagacgcgcttcgggcttgtgatgtcgtgaagccactggtcaacatctccggtgatgtccccgtcacgcctgagcttttcgacgcaatcggccacgacccccttaaggtgggtcacctcctcaagctcagcgtcggacaacatgcgtccaacagagttgttggcaatctgcgagagcttgcccttggcgtccaaaagatcctgtttcgtgctcatgttctcatatccattctttgcgtatttgatggtggtgtcgatggtcttgaataatggctccaagttggaggggtaggcggactccgatttcacggcctcgatgctggtgtccttgttcgcgccgtggggcacgatggacacttccagcaggttcacggcctgcaattcgttggccatgcccttggcgctctgagcctgcgccttgcgttcgatcgtgtacccgaaactcatttggctgagcctatggcctttgagcagccggtacacctgagcggccttcgcgttcgtgtcgatgtccaagtggcccgtaacaagcagcccgtggtcgtcctcgatggccgacttcacatagccgatgttgtagtccgggtcagtctcgttatgcccgtacagcactggaatgcacgaccccgacatatcccacttgcgcaacgtctgcgagaacgcgcccttggcaaccacgtcgccgtaacagtcgggcgtgcgcgtccaagtgctcacgtaagccttgaaatccccctcctcaagcccatcacccaaggaatcggacttcacatagatgtgtgaatcattggttttgtaatacatatgcggatacacctttgctaagccacaccggaaagcgtggtaacaatcaatatgtggttatctctatccgcgtgcctgtggcgactgcgtgcagcggcctcggctggcaaacagtccggtctcttgcgaacccgcggcgactgtacagcggcccggatcggcttcaccgaacaatgccaagcctacccgccgaacaagcacgtggcaagcgggacaacggtgggagatgacggcgcgttaccgtgtggcacgcgccgtcacgtccgaaaaggcccgatctttttgagacgcgaaaaaaagagtttcggcggcgggtgtttcgcgtctattgttttattttttggactccccctacccttgtcggcaaggtggtcgcgtttcacgatgcccttgctgatgatggggtaacgattcgttaccccatggtggttcggttaggttgtggtgtgccggtgtatgggtgtgttgggttgcggtgcatggtcgtatcctccgtgtcggtgttgtcggttggttgggtggcgttgcggtattggcgtgcgcattcttcgagccagtccgcgagttcgtggcgtgcgtagtcggccagagcgtcgagttcgtcgggtgaggtgaagtcgatggtgttgctttggtcgagcatggcttcgatgccggtgtcgtcgtactgggcggcgatgaatgagaggccgagccggtgttcgtgcatgtcggcgtagatgatggggttcattgttcctccttggtggttgttgttgtggttgcgagttggtggagtatggttgcggtgactgcgtccgagtatgggtcggcgcggttgagccgtgggtagtgtggtggtgtgccgtgcatgagtgcttgggcggctgcggtgagcaggtcgtgtgcgatccggtgtgcgcgtgcctgttcgtagtgggtgtcgccggtgtggatcatgtcgggttgctcttgaggtttgcccatggggtgctccttgtggtggcggtcattgtgtggtgaggtcgtggagtagtcgcacgtaggcggcgcatagggtggccgtgggcttgtcgctgtagtcgagttgttcggctatgaggcgtgcggctgtgatctgcgcggcgtgccggtcgtcgtctaggtgcagggcgtctatggtgcggttgagcgcgggtagctggtagatgtcgttcatggtgtggtgtctccttggttgtgttgttcccattggttggctatggcgtcgagggtgtcggcgtagtcgtggcgtatgtggtctgccatgtggcgtagttcgtctggtgtggttgcttcccagtcctgtagtgtttcgtttctgaatgcttggatgttggtggcgtattcggttacggtcatgtcggtgttgattgcccagtcgtgggcgctgaggatcgtgtcggcgttcggatcgtagtcgatgtcggcgtgtggttgttggttcatgtgtcgctccttgtgtggtggttggtgtgggtggctgtttttacgccccatatgggtgatggggcgtaatatggggtgtattcaaacgctagtgtttccaacggttttgattacgccccattacgccccatctcagacacggtgtgatggggtgtaatcattacgccccatgtctcgtgttctagatggggtgtaatggggcgtattaataaacccttgcaatataaggctttaggattaggccccatatttcaccccatgtgttgatggggcgtaatacgtgcttgtgcattcgggttgttcgagttcccatagcgagcggcgtccacgtccggtgtatgtggggtctttgcgtgcgatgacgcgcggggaggtcaggcgttcgcgggcgtgctggagctgtttgaaggtgtatccttcggcgtccttcgcgtctgcggcgatctgcttgcagttcgtcggcccgttctcggctaggtaggctgtgagccagtcggccacttcgttgtctgctgcgcggcctgtggtgtcgcctccggtgacattgcggttgatgacctcgttcacgttcgtgtcggtcggcgtgaacccggcgatgatgggtacttccatgcgttccccgtcgtcgtcggtgatgaagcgcggggcgagcgtgtacttgtaggacgcgccctgttgcggcgtgtacgagcttttatcgagcgtcaccacacattcgcccgtctcgtcgtccttggccacgaggatcagcgagcgcacggtgtcacggaaggcgtgcgagccgctcaccttgtcggaggcgtagccgccgcccttgttgaagtgcagtatgccgatgatggcgataccgagttcttgggcggttgcggccaacgggtcgaggctgcggcgcacgtcgtcgcgcttgtcggtgttgccgtcgatgcacgaggtgatcgggtcgatgaccaagagcttcacgtcgtgttcgcggagtgtgtcacgcaaggtggcggtgtcgtcgggcagttgcaggccggtgcttaccgtgttgccgtcccttgtgtcgtccacggtgaggaacaagacgcggttcatgtcggcgcctgcggcctgtaggcgtgctttctgcattcccatgtcgtcctcgatggcggcgaacgcgacggtgacgggctggtgttgccagtcgcccgtgagcttgccaagtgtggccttggcggctatgtcgatgctcagcgtgctcttcgatacgcccgcacgtccggcgatcagcgtgagtactttcgtgggtacgagcgggttgtgcaggaacactgggcgttccactttcacgtcgcaggcgcgtgtgagcgcgatcctacggccgtcatgctgtgcgcgcgcctgtttctctacgttgtcccatagggcgtccgcgatggcttgttgttgcgggtttgccgctacctctactcccatttgtgtgctttctgttcttcttcgagttgtgcgcgttgtgtgtcggtgaggaagtcccatacccaaggcaggggtttgccgcctgcggtgcgtgggatcccgtcgcccacgtaggcgagttcgtcgggtgtgaaccgcacgagcggtgagcgtgccaacgagtcggagatcatcgatcccatcggttttcctccttgctggtggtggtggcgagtatggccacgatgcggccgtcgatcatgctgagcagggcggcttggtgccatgcggcggtgtcgtcgcctacgtgcgcgatcagtgtgtcgaacatgcgtgcgatgtccctgtgcagttctttgagcgcttcctgtgtggtgttcatgccgtcacctgccgtccggtgtggcgggctgccggtagagccatgcggcgaagtcgtcgcgtgcgtaccatgtctggccgttgacggtgtgggtgcatttggggccggcgtggcgatcctctttgagggcccatagggttgtggtggtgttggtggcggcggcgagttgttcgcgggtgaattgtggtggcaggctttccacgagcgcgtgccggttgtcggtgatctgctgttcggtcatggggtgcttctttcagttgttgtacgtgttttgttcggtgtatgcgtcgaggtcggattgccggtagcgtacggcgcgtgtgtccttgacgctgccgggtcgtagcgtgccgagttttatgtatcgcggcccggttctttcggcgcgccattgggctagggtgaggcggctgacatggaggtaggtggcggcttcgtccggtgtgagcagtggtgtgcgttgcatggtggctccttgtttcacacggtcgggcggttgtcgatccactggtcgacgtctttgggtcgccagaagagtttgcggccgatgcggatcgcgggcggcacttcgtccttgtgggtgcggcgcttgtggtagatggttgtggcgctcatgccgattcgttcggctacctgcttgatgtcgagcagttcccttgtggtcgttttcggtgtgtctgtggccatatcctgtccttatgtatccttgtgcgtcgtataggactacacgttttccattcattgtattcctataagtcctataagaacctatcgggcgtgtcggtgatacgctgtgcatatggaaacacgtgaaattgcaccgctcttagaccgccgagtgaagatctatgaccgctccctgaacatgagtactgttgtggatatcgcagaggacgttgacgctccagcgcgtttttccgtcactgatattccggtggaaggcaaagaaggcctcatgctggcccttgatatcaactactcaggcttcccacgggacgaatacgacgtgattggaatgcgcctgtacagcacagaccccgcccgaacttggatcatcaacgcaaatctcctgcgggcattgcgtatcgaagattgcaagaactacgcggtgagccttgttcttctgaggtacaggccgggcactccaatcagtgacttcgattacatgccctacaatttctggaacgatctgcactatgtggcacaggctagggaagagtccggttcccttgatctgaaagcattcgcgcggctctattccgtcgcaacgaagatcatgaagaacccgcgtgaagtgcttgccggggggttcggcgtgtcgaaacccgctgtggcgaaatgggccgcaaaggcccgtgcagagggcctgtacaccgcgtacactccggccgaaaaggacaggctgcgtgctgcggaaatcaaggcgttgaacgagccgatcccggacaacgagtagagacttgccggtggggggttgacaccggcaacaggcgacgcgaacctcataatcaatggacgccaacggcccgcgccgccaacagggaagccccggtcatgcgcccaatgatcggggctcacccatatgtgaagcggcgcatggtctgcctccttaccatgcgccgctttccctatgcgcgcactgtctcatggtggggttgagatgaaagcatgagctacacagtggggaagtacgagacgaaaaagtgtgtcaagtgggaggtgcgctaccggacaccgggcggacggacgacgcgcaaacgcgggttcctgcgcaagatggacgcggaagcatgggccgctgagaacgtggagatcgccaaggccaagggcacgttcatcacgcaaagcgcggggaacactccagtggcggaactgtggcagtcgtggatagagacgaagcgcacacgatgcaaaccaagctacatggaatcattggggggcgcgtggaataagcatgtggggccgcaatggggtgcgcgcaaggtcgggtcgatacgccacgacgaagtgcaggaatgggtgaacaagttggctggggaatacagcgcgtccgtggtgatacgcgcacgcgatatgctcaagggtctgttgaaggccgcggtgaagaaccggctgatcgcgtcgaaccccgccgacgacatcacagtgccccgcaagaagaggaaagaccatgtatacctcacggccgagcagctcatggctttggccgacgaggccgggtggcgtcggccggccgtgctcgccttgggcacgactggaatgcgctggggtgaactcgtcggcttgcgggtgcgtgacctcgatgccaaaggacaccggctcaggatcgaacgcaacgccgtcgaggtcaaaggggaggttgtgataggcacgccgaaaacatacgagaaacggacgatcacctacccggccatattggagccgatgctcgtcgagatggcgcaaggacgtgacggcgacgaacccctgtttgtcgatcagcaagggaagatgctcaggcgcactcatgggccgaactctccaagctcgtggttctattgggcgaagaaacgtgcgctgggtgatgtgttggcgaggaagatgaccgtgcatgacctgcggcacacggccgcgtccctgctcgtgagcgcgggcgcgaacgtcaaggtcgtgcaaaggcagttggggcatgaaagcgccgccatgacgttggatacttacgccgacctgttcgacgccgacttggacgtggtgcgcgtggagatggacagcatcttcccggccgcctaggctaaatgcgtccaaaacgtgtccaaaacacagatgtgatgcttgagaatggcgttatttcaacgttttctaggatgatatgttggggttcaatcccccgcggctccacaaatagcataaaacccactggaaatagtgggtttttcgtatgtgaccggctatgtaccgcggcgcggtgtagactatgggtatccgcgacttggaacaacgttccgggtgaagtacgggaatgatggcgagggcttatgctctcgccatcattgattgtggcgttatatgccaagctcctccgtgtcgaacaggatcgtcaccgggccatcattgaccagcgacacattcatatgtgcgccgaatctgccctccttcacctgaagtccctgcgcgcgcaacgcctcgttgaattcgagccagacccgttcggcatgctcgggtttgccggcgcgcacgaagctcggacgattgccttttctggtgtccgcgaacaatgtgaactgcgagatagacagaatcgagccgccgacgtcgtggatagacagattcatcttgccctgttcgtcttcgaacacgcgcagattcgagattttgtgggcgagccagtcgatctgcctggtgccgtcggcatcgctcacgccgacgagcagcacatagccggctgcgatggtctgttcggtgaatgtcgtgtcgagttcgccgattgcctcgtcggtcacggtcacgccggcgtggctcactttctgcaatacgattctcataccggcactatagcgcggcggggcgtaagaaaaccggagtcgcagcagtctgcagactccggttcattgtcggaaaagcgtcacgctcacttgccgatctcggcgaggtagtcggtgatctcggccgggtaggtcggccatgcgccttcctgcgtgcacacgaatgcggcggtgttcacggctgcgcggtgtgcgaggccgagggagtcgccgttgagaatgcggccggtgaaggtgccggagaacgagtcgccggcgccaacggtgtcggccacggtgacgtgcggggttgccagcgtggagacctcgccgtcgttcgacatgatcgtggagaaggtggcgccgccggtgagaatgaggtagcgcaggtcgaactgctcgatgaaccacttgcaggcctcttcgtcggaggtgttctcgatgccgaacatgccgcgcatcagcagcagttcctcgtcgttgatcttgaagacgttcgcatagctgagcatctcctcgatgagctccttcgaatacatgtcgccacgcaggttgatgtcgaagaacttgagcgcgccgtccttggtgtgcttgagcagctcgatgatcgtgtcgtgcgactcgggggagcgctgtgccagcgtgccgaagcacacggcgtcggcctgctcgacgatgtcgatgagctggcgggtgtaggagatgtgatcccaggcgacgttctcgacgatcgtgtactccgggatgccgttcttcagggccacctcgacggtgccggtgggccatgcgttgcgctgcagcacggcatggatgccggccttctccgcggcgatggcgagttcatcgccgagctcatcctcgccgacggcgctgaccgcataggcttcgcagccgttgttcgtggcgtggtaggcgaagttcaccggggcgccgccggcacgcttgccggtggggagcatgtcccacaggagttcgccgagggagaccacgattggctttgacatgatgtcacctttcttgtgtgttgttgtttggttgtgttgcttgtgaacggattaattcaattctacgtaccgctggcaaagaattgcgatggatggtcgagaatgtacgtaatcgccacagctgcggcgccggtcaccgccgcatcggtgggcagtgccgaaagctcgatctgcgtggactgcgtaatttcggggatcacgcgctcgccgaccacctcgcgcacgcgctggagcagcggttcgccggcttgcgccacgatgtcgccgatcacgatgcgagatggattgaacgcgttgcagatggtcacgcagccatagccgacgaacgtgccgatccgctcgaccagctcacgtgcctgcccgtcgccggattgcgcccgtgcgaacagctcggcgcatgcctcgcgatgggtgagccgggaatctgtggcgagcatgccgttgccgagcatcgcctcgtgtatggcgaccgccgagcagtagcgttcgagacagccgacattgccgcaatcgcatgccttgccgttcacgtctatgctcacatggccgatctccgtggccgcgccgagcgagccgttgatcacggtgccgtggtcgatgacgcccaggcctatgccttcgccgagcagatagtatgccagattctcattcgccggattcgggtcgaagagatactgggcgagtgcgccggcgcgggcgtcctgttctatgatcaccggcacgtcgaaggcatgttcgaattcggcgcggaagttgacctgtcgccattgtcccatggatgagacgaccgcagtgtgcccgcgatcgcgcaggtaggggcccggcacggccatgccgatggccaggatgtgcgggtgctcggcgagcaggcgtctgatttcggcatgcaggctttcgatggcctgcggaatcgtcgtgttctccacggtgggtagttctcgtatgaacgatggcttgccggcgaggtcgaacagaccgatctcgatgagactgcgcgcgaatttgacgccgagcacctggaacgcccgggcattgaccgccagtccgattgacctgcggttgcctttgccttcgagggcaccggtctccacgattgcgccgctggcgagcagatggttgctgatcttgctcagtgccgccggtgtgaggtgcagtgccttggcgatctgtgcgcgtgaggcgatgccatggtggtgcagatactgcagtgtgcgggcccgattgtattcgctcagggtctgctgttcggtggtggtccgcgagttcatggcacctccttcggcgttcacttcgttgtgtacggccgctgggcagccgcgaactcatgtgttaacgatgtttatatattaacgcagttaatacatgcgacacgcccaaaaacacggcacccgaattgagtgacatgcgcgatgccaatcccgattcgggtgccgtgtgctattttctgccaaaccattactcggacaggtgcccggtggagttcggcagcatccattgattcatatgccgctgtatgcggcctacagatgctcgatgaccccgtcgaacgcgaactgtgcccgtgcgcttccttccgcacggtgcctgagataccgctgcacgtatgcgatgcgttcgcgtgtgctgtcgctgagcggttcgggcagatcgtcgagcgcgaaccacccgacgcgcatgctttcgtcatcgccgacgaccggttcgccgttgccgcccggcgcgacttcgcacaggaacaggtgatccatgtactgcgcctggtcgccgttggcgtaggtgatcatgcgccggtcggatttcacgctcaccagatcggtgacgatcacatcgacgcccgtctcctccttcgcctcgcgtgcgacggtgtccgcaggctcctcacccggctcgttgatgccggtgacgagcgtccatttgccgttgtcggtgcgctgttcgagcaagacaagcccgtcgtcgcggcgcacatagccggtgacgccgatgagccacagtggcatgtggccgatgcgctcgcgcaattcgagaatgaaatccggggtcggcatgatgctcctttcgagcgactggctcagttgttggtgtccgccatctgcgccatccaggcctcgacgtcgtcgatctgcttcgggatgccggcggagatccattcggggccatcctcggtcatcagcacgtcgtcttcaatgcgaatgccgatgccgcggtactccggcggaatcatcagatcgtcctcgcggaagtagaggcccggttcgatcgtgaacaccatgcccggcgtgatcttcgcaccttggtacgactcatagcgggcctgcgcgcagtcgtgtacgtcaaggccgagatgatgcgcgacgccgcatgcgagccaacggcggtgctgctgtccctcgggcgaaaggctctcctcgacgtccaccggaagaatgccccagtcatgcagccgttcggcgatcacgcgcatgcaggcatggtggatgtcggagtaggtcgcgcccggcttcgcggcttcgaacccggcctgctgcgagtcgagcacagcctggtacagcttcttctggaaatcggtgaacttgccgttcgtcgggaacgtgcgcgtgatgtcggcggtgtacagcgaatcgacttccacgccggcgtcgatgagcagcagctcgccatcgttcacggtgcccgtgttgcggatccaatgcagaatcggcgcatgggcacccgaggcgatgattgtgtcatagccgacctcgttgccttcctcgcgcgaaaccgcattgaatgcgccttcgagaatgcgttcggagcgtggcttgcccagtgcgctcggcagcttcttgagaatgttgtcgaagccgtgcttggtggcgtcgacggcacggcgaatctcgcgcacctcgaagtcatccttctccatgcgcgcttcggaggcgaattcgtgcagcttgtcgtcgcgcaccgtattgtctgcctcatccgggaaaccatgcccctcgcgcagctcgttcacgatggccgtgatctgcggatccgtctcgcgaatcacgcgcagctgcacggcgccgttctcagtgccgacgtccttgccgagcatgtcgtccagctgggcgatgtcgtgtgtttcaatgccggtcatcgcctcgagctccttcaatccagcgcgcgggccgacccagtactcgccgtagtgtgggtccttgaagaagtcctgtgtgtagtggtctgcacgcggggccacgaacagcatcggcgtatgcgtgccgtcctcgttcgggtcgagcacgagcaccgcgcccgcctcgtagtcctggccgagaccggtgtaataggagaacgcggaatccgggcggaacgcgtagtcgcagtcattgttgcgcaccttcggctggcctgccggaatcaccagacgttcgccggggaacgcctcgctcagcacctggagtcgtgccggaatgtaggaggcggattcaaggcgttcgatctcgggctcgttgttgtcccaaccgctgctcatgaagtccacgaacgcatcggaacgcgggcgcagcgaacggttgttcacacggtcgttcattggctgatcgtcgccgggtgccgccgcctgctcacgcgcctcgtattccttgtcctgctcggtgattacttcgctcattgctgctcttttctccactgtttgggcatgagatatccgttgcccaacatggtagtcgcgggcgcgaatctgttcgtcgtgcacagcaggccgccagtgtcggctaccgaacacagtgtgcggtcaactctgttcgcagattgaccgttttggggacagcgatagattgagtgtcgcgctcgctgatgctggaatggaagtacatcaatcattcaggaggtgagcgcgatgcgtaggatattcgccaagatcgcagccgtgatatgcgtatgcatggtcgtgggcggatgcagcgtgcgtgacggcatggccggggcgttcggaatgaggatcgtctcgccggagtctgcagaacttgatgatgtgattgcggcgattgcgctcaacccgtcgagcaagaagttcgagaccgtcgacaagggctatgtggcactcgtacacagcaatggccgcgcggaatacatccagacggaaggtatgctccaacagcacatcgtgtggaacggcaccggcgtgttcttccaggaccagaagcgtgactacctgatttcgaatgaacactgcaagggatatgtcaaggaccggcaagaggcgttcggaacacaatgggcgttggtatcggttgcgaacgacgcagggctcaccgtaggcgaccaactgacggtgttcctcgaatccggagccatcgagacagtgaacacaaccacgagccacatcgaccaccagcacttccatcttcccgattcactgggcaatgacagctacccactctcgaggacccttctgaccaaagggaccggcggcttcgccacggtgattgcagtgccggaggatgggcgcaatcgctgcaagatcctcgtatacaagctctacgaatcggacattcagaaccttgattccgtatatgccatcgacaccgacggcagactcaacgagatgctgagcggaacaaccgattacctgtcgactgacttcgcacccaacccacgcatgcactggaaggctccggatgccaattgaacttctgattcctcatcgttcgattgccagagtccagattccatcctcctcgctgacggtcatcgccgcgccgaggtcgtggagtctggattcgagcatctccagaccatgatgagccgaatcaggctgtgcctcacccgctgcaatctcgttcgaggcgacaagtgtggtgcgctcgccgaacctgatgcgcaccacatacgaatgggtgccgtgcttgaggatgttgttgcagatctccgtaaggcatatgttcacgaggttcgcggattcgtctgtcgcctcgccagacacatgaatcgtgccgttgaatcccgcttgttccagcagtgccggctgcctgagcacgttctggcataggcgagcgcagctgccggtggtcgtcgactcatccacgttacgggatatcgccgtggatgccggtgtggatgcggaaagtggcgtgatgatattggtgcgcagatctgcaagcgtggattccacggtttgcgtgattgtctccagcgacgtgcgcagcgtgtccggatcggtctcggcctgagcgttccggcatagcagcagtgcgtaggagagcgagccgccgatgtcgtcgtgcagcgtgcggacgagatgaatctgcttggcttgttcacgctgttcgtatctgagtcgcgcgaactccttgttgcggcggattgcgaggccggcgaacccatcgagcaggaacgtggcggcgaaaccgatgtcgttcgcatcgaacggcacctggaagatcgcgttgtcgaccatcgtgtcgagcgcggcaatcacggtgatcggaatcgcgtatttcgcgggcatttcgtaaccgattacgatgagcgcaagccagacgctgtaatagacggtcggaccggagtggacgactgggaagatgtagaagatcccacgcagtacttcgacgacgatgatcgacagactgaacggaaccggcatgatggcgacaccaagcgtgagcacgggaatcagtgtgctcagggcagtctcgaagccgttgagatccggccaatatgtgagccattcaaacacgagcactgctacgcagaacaatgtgcccgcgatgatgaatgggtgcgcgcgcaggtgggcgacgagtttggtgagcggtttcggtttggttggggagtctgcagatagtatttcggtcatgtcagatccacccgtttcttacgcagatggcgatggcttcggtgcgggaatgggcgtcgagtttctcatacgcgcgcttggcgaaggtcttcatgcttgactcgctcacgtgcatggtgtgggctatcgcggtggttgtaagaccttcggagtagtgggtgagggcatggagttcactgggggagagtgggtttggttttgttggggtcgggaaccagcgggtcaggtcgtcgtcacggcggagcatgccggcgagttggacgatctcctcgacggcggattccttgggcaggatgaccaaaccgggttcttcggcgatgttcgggaacgcggagatgccgatgacggtaatggggagtttgcgggtttggagttcgtggaagaggccgaggccggagaggcggggcatgtcgatgtcggtgaggaggacgtcggggcggcccttcgcatgcagacagtggacgagagcgtcttcggggtcggtgagcgcccagatcacctcgagcggggcgtggaagcgttcgaatgaggagcgtggcgcctcggcgaccagcgggtcgttgtccacaatgccgagcgtatatcggccgtgccgatccgtcgcctccgatgtcttcgtcgtcatgcctgcatcgtcatcaatacggcccccaagtcccgcgctcaaccatgtgggaaacactatagcgtgcgctggcggtggaaggtcgggcaaatgcatagaatggacgaggtttgtatacatacgcgggaagagtgcttatgagcgacaatcagatgagtgtgcgggacgtcgagcgagacatcatgaaccgtccgagcgagcggaacacgacgaacctggatctcaagcgaatgaggatgatcctcgacctgctcggcaatccgcaggactcgttccgcatcatccacatcaccggcacgaacggcaagggatccacggcacgcatggccgaagcgatctgcagggcatacggcatgcggaccggcctgtacacgtcgccgcatctcgagcatgtgagcgagcgcatcgtcatcgacgggcagcgcctgtccgacgacgacttcgtggaactgtggaatcaggtgaaggacttcgttgcgctcgtcgacaagaaaatggacgaggagggcgcgccgcgcatgagcttcttcgaggtgctcacggcgatggcaatctggaagttcgcggacgcgccggtcgacgtcgcgattgtcgaggtcggcatgggcggtcgatgggacgcgacgaatgtgctcgacgcggatgcggcggtgatcgggccgatcgacatggatcacatggcctggctcggcgacacggtcgagcagatcgcgcaggagaaggtgggcatcatcaagccgggctgcacggcgatcatcgggcggcagccgcacgagagcgaggtcatgccgatcatcgagcaggcggcggccgaaaaccatgcgacgatcatccgcgacggctatgaggcggaggtcgtctcgcgcatgcccgcagtgggaggtcagatggtcacgctgcgtatgccgaacggcacctatgccgacgtgccggtcgacaagttcggcgagcatcaggcgcacaacgcgcttgcagcattgtgcgcgtgcgaggtggtgattccggtcagcggcgcgctcgacggcgatctggtggccgaagcgctgagttcggtgaagattccgggacgtatcgaacaggtgcgctcgtcaccgacgatcatcatcgacggcggtcataatgtgaacgccgccgaggcgttgcgcgcggcgatcgaagagaactacgatttcacgcagctcgtcgccgtcgtcgcgatgatggaagacaagcaggtggaggaatatctcggcgtgctcgaaccgattgtcagcgagctcatcgtcaccgagaattcgtggacggaccgcgtgatgcctgccgacaagctcgccgagatcgcgcgcggcgtgttcgggccggagcgcgtcacctgcattccgtcgctgccggatgcgattcaggaggcggtgaaccgcgtggatgcagacgatgagctcggcgtgggctacgggcatggcgtgctcatctgcggcagtttcgtcaccgcgggcgacgcacgcatgctgctcaaggagagcgtacacccggatttgacgaagccgaaggccgagcgcgtgcatcaggtcgccgtggatccggaatatcggcagaaggcgcaggaagcggacgctgcggaaatcgattacgaaaccgatgcgaacccggatttcgacgtcgatgacgtgcttggtctgaagaagcttgcggaagacggcgaatccggggatatcgaatccgagtgatatcgccgtggtttggtcgttttcttcacacggcgcacggtaaagggtcaaactgcgggcaactatgatcactcactgggtaatctgttcaccaaacgaccatagttcgtcccactttggcggttcatatcacgcagtgcgaggtaaacgaccaaagttcctcccattttggtcgtttacctcacactgtgcgaaataaacgaccaaagtgccgaaataccgtattacaattgcatcactttgcggccgattccttggcccgcaccttctccgcattgccgtgcggcttcggtttcaacgccttgcgcacgctttgcatcatgcgcagcatgcgatagaaggccttcttgatcggaatgtcgcgcccggcggcgatctgcgtggtctcgggggcgaacttcgtcttgaattcgttgagcgacttgagtgacggggcgaaatcgttgcctatgcccatcagatcgagcttcgtgcatccctgcttgccgagcgcgcaggccacgaaatacagcagtttgtcaggcacatgctcgcgacgcaccgaagtgagcatggaggcgtagtaatacacgccagtcttgccgtgcacggtcacgatggaccatgccacgaccttgccgtcgatgcgtcccgcgaatacacggcaatgctcagggccgagcgccttgatcatgtcggtgtagtcgctcatcggcgcgggattgaagccgtcgcgatgcgcggtctccaccatcaccgcgtagtaatccgagaaatcacgggtcgccaactcggtctcgtcggcgatcacggccggcgattcacgcaatgccttgcgcacgtcgcgtcggccgcgtttcttcatgcgcgcgagaatctcctcgtcgtcgccggtgatgtcgagcacgacggtttcgttgtacggcacggtggagagcacggggaacgtgcccttgctggtccatgtgtcgatgcgcaggaacgccacgcgcttgtcgttgcgcttcacatagtcggcgagcgcggcgatcatctgctcctcaagctcttcgttcggcttgctcgcccacaccggtccgtgcacggaacgcaggtaatggtatccatgcgtctccatgtcgatgagcgagatcacggcgacgagctcggtgtcacggcgtatgagcagacatccccatggtctacggccgttgatgtccgcttggaaatccgcccaaaccgacgtctgctcgattggcagttcaatgttgtgcttgctcgcttcctcctccatggtggccggagtgacgcgttcgatgatgatcatgtgttcctttccaaggcgtctgttcccattgtaggcgcgtcgcatgcgaatcaagcgaacagacgtcggatgatctgcgagtcgccctcgtatggcgtgtggatgttgcggtccttgatccactgctcgtcgcccttgcctatgagcagcaggatgctcagtccgccgtccgccgcacgcgcctcgtcgacggcatgcttcacggcttcggcacggtcgaggatcgtctgcacatcgagatcctcgttcgtcacgttgttggccatctcgctgcagatttgctcgatgggctcggtgtcggtgtcctccgcagtgagaatgagcttctgcacgcggtcctgtgcggctttgacgattccctcgcgacggtcgtatgccttgttgccggccgaaccggtgatcagcgtgatatgcggatgctcggcgccgtaccgctgctccacgaaatcgagcaacgcgttcaccgaggcgaaattgtgcgcgtagtcgacaatggcgagcgtgttcgacctgctgtcgtgcatctcctccatgcgtcccgagatgcgtacgtcggcgagtgaggcgagcgcacgcgggtcgctcacatccatgccgatgtcatgcgcgattgccagagcggcggccgcgttcgcatagttgaagtcgccctccattgcgagcgtgaggctgccgagacgctcgccgtccacgaagtagtcgaatgccgtgtgctccatattggtcggtgcgcaggtgacgtccgcgatgtcggactgcgccggcgaatcggccaatgcgaacgtggagacgggtacgcggttcagttcggcatcctcgagcagcagttgctcgtggtcgctgcgctcgccgagcacgagcatgtcggcattgcgtatgatctgccgcttgcaccacaggtagttctcgaaactggggtgctcgatggggctgatgtgatcgggggagatgttgaggaacgcggcgacgtcgaaatggaaatcgtagacgcggttgactttgtatgcctgtgaggagacctccatcaccaggtatttcatgccgttgttcaccgcctcgcgcatcatgcgcaccgcgtcgagcgattcgggcgtcgtgaggtcggattccacgtagtgcatgccgtccacgcaattgtccaccgacgagaacaatgccgtcgtgtttccactcagcgcgttgatgatggcgtgcgtgtagtacgcggtggtggtcttgcccttggtgccggtgatgccgatcagtgtgagctgacgctccgggtggtcgtagtatgcctgggcgagaatgctgagtgctttcttgtcgtcggagacgatgagcccgggcgcgtccgtgtacgccgaataatcgttcgtcgccacgtacgccgccatgccgagcttgttcgcctgctcgaggtatttcggattgaagttccctttgcatacgagcagactgcctggcgtcaccgtgcgcgtgtcgtaggtgattgccgtgaacggcacctcgttgttctctacggaggccgcgttcatggtccacatgtgcggggtgatgatctcatgcagcagattctccgcgaagagctcgcgtgctgcggattgcaacgacaaagacatggttctcctttattccgcttgaattctaccgtgcgccgtgcatgtgcgcgagcggcgaataccagacggacactcgcggtgtttgcgcccccagctggctttcagatttccttcacctcgtaccgtacaatggagggcgtgagcgaaacaagcgagaatgaacacgaaacgatgcaggagaagcgggcgcgcttcgagaagcttgccatgcccgccgtcaatgcgctctaccgtcaggcgatgaagttcacgaacaatccggaggatgcccaggatctggtgcaagacacgttcgagcgcggcttcaaggccttcgacaccttcaagccgggttccaatttcgaagcctggatgacgacgattgaacgcaacgccttcttcaaccagtatgcgaaggcgaagcgtcgcccgcagcgtgcgaacgattccaccggcgaatacgacgactgggatatcttcgcggcctccgagcatacttcgcaaggtctacagtccgccgaacagcagtatttggaggcgttcgcgccggaggagatcatggctgcgctcgacaggctccccccggagcgccgtcaggtgttcatcgatgccgccatcgatggcaagtcgtaccagcaggtggccgatgaacagggtatcaagatcggcacggtgatgagccgccttaaccgtgcacgcacgcaactgcgcaaggagctcgccgaatacgccgccgcccgcggttacggcaaatccacgaagacctcccgtggcacttcgacggccaaagcgaagcgtggaaataaaacggaggcgaattccgttgagacaaatagcaatgaaacgcgagatgacgctcgcgagaaggaactagttggagctcacggaaaggcgaggcaatgagcaagggcatatcgcagcctttggatgagcatgatgagcctgtgtcgctggacgatctgcataattcgaatgatgcatccgcgccgcaggtggagggggagtgcttcgatccgtcatcatgctgcgacgcgcgtgaacaggtgatgatcgccgctatgaaagcgtatttgagaccccagcaggcgccggaatgcctgtatgaacgattgaagatgacgctggacaaatgctgtggcgaagtgatcaccgagcacaccgtggtcacctcgcatacgatcatccatcacacgcaccgtcagggactgtgagtggcatcgccggtatccaggtttcccggatgccggctttttggttatggttgcgcattggtttcatatatgcgaaaaatgggagaggcccgtggaattccacgggcctctcccatttccgttcaagacgggtcacagctgctcaggcatttggccttttgccgtgatttgctgcctttttacggcgagccttacgcttacgtccgcgcatacccatagtggactccttttctaaagccgtcatatgccttatgcattgtcgcatgccgcccagacgttgcagggtgcatacactttgcacagggcacaatggtcatagtgtagccgtgttgacggacggcttgtatgtcactgaagcacctgatagcgaatcgtcgtatgcgcggtgtctcccggagcgatctcgatgaggtcgatgcctgtgcggaacgtgttcgcgtacgcggtctgcggttccacggcgacgccggtcggatggatcgcctcggggaagccggtgccggtgcacacctggaacgaggtgatgctctcgtcgccgatgatcgccacctgccggccgtccggccgcgtgaacaccgcggtcacggtgccgtcggcggcatgggtcaggtcggtcagcgcgtcgtcgtacggctgccggtcgagcaacgcggccgtgcggaaatcgaatttcgtgccgtccaccggctcggttccggtcgggatcaggttcccattggtgagcacatgcgtgttcgcgggaatctgcacactgcaacgcgaggtgacggcgtcgatcgcgttgccatgggcgtcctcgccgttcgagaaccacggatgcacggccatcgcccacggtgccgggccgtcgccgttgttcaccgcgtcgcagtcgatgcgcatgccggaattggaaagcgtgtatgtgatgaacacctgcagcgagaacgggtatccttcagtgagcggcacgcgccagctgagcgtaacggaatcttcggtgagtcgttcgagctgccagtagtagttcatgccgaagccgtggatcgcgttgtcgcgctcgggttcgttgatcggcagttggtagtgggcgccgtcgaaatcataggagccgtgctcgagacggttcgggaacggcacgagcacgcggccgacgcagcaggtgaccacatcgtcgggaccggtggacacggtcacgtcgtcgccttggtatcggaacacgcgcaatgtggcgccaagctgcgcgatcaccgcggtgtaatcgccgtgtgaaatggagaattgctgacctgtgcgagggggaagtgcgctcatgggactccagtcgtcgttgattgcctcgttgttgagacgtgtgcccattgtagcgcgcgtggcccctatttattcagcgattcaaccaagtgtagtgttcattcattcggttatgattgatgcgacgaaaggcaggcatgacgaaacgaatcattctggcgaatccgcgcgggttctgcgcgggtgtcgatcgcgcgatacagtccgtgcagaccattttgaacactgccgcgccgcgtgaagacgatctgcccccggtgtatgtgcgccggcagatcgtgcacaacaggcatgtcgtcgacgaactcgccgagcagggcgccgtgttcgtcgacgagctttccgagattccccaggcggcggcgcaggccggcataccggtcgtgttctccgcgcacggcgtgtcgccgcaggtggtgcgcgaagccaacgaactcggcatgagcgtcgtcgatgcgagctgcccgctggtgagcaaagtgcaccgcgaggtgttgcgtttcgtgcgggaaggctatgagatcgtttatattggccatcgcggtcatgacgaggccgtgggcgtgatcggagagtcgcccgagcatgtgcatctgatcgagcatgagcgcgatgtggacgatcttgatttctcgcccgaccaaaagctcgtgttgctttcgcagaccacgttgagcgtcgacgagaccacgggcacgatcgccgcattgcagcgcagattcccgtggattgaactgccgccgagctcggacatctgctacgccacgtcgaaccggcaggccgcggtgaaactggtggccgaacaggccgatgccatggtgatcgtgggttcggcgaactcgtcgaattcggtgcggctcatggaggtggcgaacgaggcgcttggcggacgtggcaccgcccaccgtgtcgatgacgccgacgagctcgattccgcatggttcgaaggtgtctctgcggtcggcgtgtcgtcaggggcgtcggtgccggacgagctggtgcagggtgtgatcgacgcactgcagcggcttggcttcaccgaggtcgacacggtggagacgattgaggagaacatgcatttcgtgctccccgcggcattgcgtaaacgaggctgaacatccgaccacgctggtctgcctctggcggtgcgggggatggccggcgacatttcgtcactgtcgcaagctcccttacgttcctcaacgtcgccggccatcccccgcaccgccgctttcgcacgttccctgaggtggggcagccggtgacattgaggaacgtaaagggcgcttgcgatctagtgacgaaaggtcaccggttgccccactgccagggaacgaggatattagtacgatttcttctgtgtggcgattggtgcggtggtggcgtcgagcacggcgagcagatcgtgcgggttgacacccagactcagtccgcgtttgcctccggagacgagtatctcatcgaattcgagcgcggattcgtcaagcaccgtcctatgttgcgttttctgtccgagcggggagatgcctcccaccacatagccgctttcacgcatggccaccttcgggtccgccatctccgccttcttcgcgccgacggcatgggcgagctccttgaggctcatatggccgttgaccggcacgacgccgatcacacgctcatcgccggtgtcggccatgagcgtcttgaacacctgccgttcgtcgtagccgagtttgcgtgcggcttcgagcccgtatccgtcagcatcgtcgttgctgtgttcgtattcgtgcgttgtgaacgtgaccttggtgtcttcaagctgtttgatggccggcgtcgcggctgccctccgcttcttcttacccatgctatcagtctaggaccacagctgggcagggggagagagactggttacggcgtccattctgcgtaatcggggacagctgcgggctccatctgtctctgtttacgcagaaatccaacgcatccaagcagcaatccgacgtaaaagggggcagatggagcccacggctgtccccgattacgcagagacgtaccaaggcgcataggcacaaccctgcgtaaaaagagacaattgcggattccatctgtctctttttacgcaagattcaagattgaggtattgggatattgaaatattgaaatattgaaatatcgcgataatagcgggatcaataggtggcagtatttggttcggcattcaagcggcatacgaaagggccccgcgtggaagcggggccctcatgctcgtgatgcttggctagaagctcactcggagatctcggcgaagtactcgagcgtgcgcaccatgttggaggtgaagccgtactcgttgtcgtagaaggcaacggtgcgggccatggtcacgccgtcaacggtgttgacatcggtctgcgtcggatcgaagacgccaccgtgggtgtcgccgacgatgtcgccggagacgatctcatcgtcgttgtagccgtagtaggcgcaatcggcgaaggcatccttgaatgcggcgttgatctcgtcaacggtggcatccttctcgagcacggtgaagagctcggtgatggagccgtccggaacctgcacgcgctgtgcgtggccctggagcttgccgttgacctccgggacgaccttgccaatggccttggcggcaccggtcgaatgcgggatcgtgttgatcgcggcggcacgcagtgcacggccgctcttgttgccacgcgggccgtccagaatcatctgggtgccggtgtaggcgtggatcgtggtcatgaagccggccttgatgccccacttgtcgttgagcagcttgaccattgcagccatcgagttggtggtgcaggagccggcggacacgatgttgtcgtccttcttcagaatgtcgtggttgacaccgaagacgacggtcggggtggtctcgtccttggcaggagcggagatgagcaccttcttggcgccggcgtccaggtgggcctggctcttctcggcggaggtgtagaagccggtgcactcgagcacgaactcaacgccatcgttggcaacccacttgaggtcgcgggcgtcacgctctgcgtagaccgggtattccttgccgtcgaccacgatcgcggtgtcggtggacttgacgtcgaccggggtgccgtcaacgtgcttgaacacaccgtgggtgctgtcgtacttgagcaggtatgccagtgcggcaggcgaggtcaggtcgttgattgcggtgacctcgatgtcggcggcttcgccacccttctcctgcagctcgaagatgcggcggaaggcgaggcgaccgatgcgaccaaagccgttgataccaatctttactgtcatgtagttctcccttggggatgccggcggatgcatagcacctgctggcttggttaaccaacattgcccattctaccggcgttgcttgacttcaagcccccgcttgcgcgccgaaagccgttggaattgttggcgaacgattatgtctcacattgaggcgcccaatgctcggtttgaacgctcgatatgctacgcggaaccgaacccgtgatgtctgttcgcgagatatcgcgctatgcgagcgcgtcggtgacgtgtgtgctcggttccccgagtgtgccgtgaggagtcgcgccgacgagttcgggcaacggtgcgcgatcgtcgaacacgatgatcgcaatcccgccgcctacggcaatctgcgcggcatcgccgtcgatgaactcgttgctcagtccgttgacttgcagattgctcagcgtcgcatggtcgagtcggtatttgagaccgcgctcggtcacgtcgcgcacggagtcggaatgcgcgaacaccgacacgtactgggtgtcggcgacctcgtgcgcggcaaagtgcagtgcggcgtccgagatcgccgtgacgatgcggccgtcgccgtgcagataggcgatgccgccgtgcgaggcgacgatggcggtctgctgaatgtcggagatcgtgtggtccacgcggccgccgagaccgccgtagatatggaattcacgcgacccatgccgccagcccactttgagtgcggaaagcatgtcggggtcgtccttctcgggagggagcctgagtgtgcgcataccgggatcgctggtggattccgtcgcgagatcctcggtggaatcgaagtcgccgacgaccacgtcgacatgcacgccgagttcgcgcgcatgggcatagccgccgtccgccgccacgacgaacgcatgctctggcagagaatatgggcgcgtgtaatactcgccggcgccgaaaacgacgcagattcgggatgcggtgttcgtggtgaccccctccgcttggcttgccggcgacttgcgctgccgtgctacgcatatgattcctgcacccatggtaatgcgggggagggctgaaccgggtatgggggtgcacgaacgccatcgtccgcgcacccgaatactcactccccattgtagaatgccgcggttttgcgcgcctgtgtaaaaccgcggcgcatgtctgaatgaaagcccctgccgtggtagattttcaagcgcatgcgaatctggtgagtctgccggctgcgtgcgggcgtggcaatggaatcgccttggtccaggggtgtggtattatctaacaggcttgagaaatcaagaaagtgggaaacccacctggaaacctgtcatggtttcgggtcacggcacggcaggtgcgacgtccgatctgcatgggcatgcggaaacggcgtttggaattgcatgtctaccgcatgtatgaggtcttcgaaggccgttttgctgctgccatggcgcgagtatgacatccagaggtccccggcacaatatgaggaatggagtcatcattagcgacgaaccacgcattaacgacgagattcgcgtctcccaggtacgccttatcggaccgaacggcgaacaggtgggggtcatcgcgacttccgtcgcactgaacctggcaaaggaagcgaacctcgatctcgtcgaggtggcgcccaatgcgaagcctccggttgccaagctgatcgattacggcaagttcaagtacaacgagaagatcaagcagcgcgaagcgcgacgcaaccagagcaccgcggaaatcaaggagattcgtttccgcctcaagatcgacgaccacgacttcgaagtcaagaagggccacgttgagcgtttcctcaacgcaggcgacaaggtcaaggtcaccatcatgcttcgcggacgtgagcagtcccgcccgatcggcggtgtggagatgctgcagcgtctcgccgaggaggtctccgacctgggcactgtggaacacgcaccgaagcaggagggacgcaacatcatcatgacgttggccccgaagggcaagaaggtgcacacgcagtccgagcagcgcaggcgtggcgcagaatcccgcgcggaacgccaggcacgccaggcagctcgtctcgccgccaagcaggaggcgaaggccgaggaggccaaggaagcccaggccgctatcgacaacgagtagcaatagcaatcttcaaacacgaagaacaacaaggagggcagcaatgccgaagatgaagacaaagaccgcagcagcaaagcgcgttcgcctcaccgcaaccggtaaggtcatgcacgctggcagcggcatgcgccacaacctcgagcacaagtccgctcgcaagcgccgtgcactcaagcgtgacgacgtgctgcagacggcacaggccaagaagatgaagggcctgctcggctgaaaccggcatcgacaacaacgaataaagctttactggaaagaggaatcacatggcacgtgtcaagcgcgcagtaaacgcacacaagaagcgtcgtacagttctcgagagggccaagggctaccgcggccagcgttcccgcctgtaccgcaaggccaaggaacagctgctccactccttcaactacaactaccgcgaccgcaaggctcgcaagggtgacttccgcaagctgtggatccagcgcatcaacattgccgtgcgcaacgaaggcatcacgtacaaccgcttcatccagggcctgcgtctggccggcatcgaactcgatcgtcgcgccctcgccgagctcgccgtgaacgatccggacaccttcaagaccattgtcgagcaggccaaggccgctctgcctgaggatgtcaacgctccggtcaacgcctgagcttcaggccgcaacagtgacgccatagcgttctccatgtgaaagaccccgtccaatgtggcggggtctttcacatgccgcaatcagcgtcttctgccgtctctccggctatgcgtaatctccccgccgctgtgtaatctctccgcctctgcgtaattagggacatctgatgcccccctatctgtctctttttacgcaggggagggcctgtggcgtaggatggttcccctttttgcgtaagcggctcccctttgcgtaatcggggacatccgatgccctcaatctgtctctttctacgcagaaggggcgcagggaaaaactggcgcgcaatgacaatccgaagatgctgatatacagatacattgattagggagcagaaggaggcgtggcgatgaacggcgagctgccgatgctcgaggcgaggttcctcgcgcatatcgatgtggaacgtggcctgtctgcggcgacggtgcaggcatacgagaacgacatcgaccagtatgtgcgttggctcggcgaacaggggatcgccaaggccgcgtccatcacgtcgaacgatgtggaggatttcgtcgccgcgcagtccaagtcgggaacaagcgcggtctcattggcgcgtaggcttgcaagcatccatatgttccaccggttcatgcaatccgagcgtgtggtggccgacgacgtctcacagagcgtgcgtccgccgaaatctgcggagacattgcccgaagtgctcaccgtggacgaggtgcagcgtctgctcgatgcggcgcggcatgacgacgccagcgaggcggtgtcgatgcgtgattcggcgttgctcgagctgatgtatgccacgggctgccgggtgagcgaggcggtgggactcgacttcaccgacgtcgacatggatgcgcaagtggtgcgacttaccggcaaaggcgccaagcagcggctcgtgccctttggcacgtatgcggcgaatgcattgcgcgcgtatgtggagcatgccagaccggaactcgagaacaaggcgaaaggcgagcgcgagcgcagcgcgatcttcctgaacaaacgcggcaagcggctcacccggcagtcggtgtgggagatcatcaagcatgccggtgcgttggcacatgtgagcaaacccctgcatccgcacacgctgaggcattccttcgccacacatatgctgcagggaggcgccgatgtgcgcaccgtgcaggagctgctcgggcacgcctcggtgaagacgacgcaaatgtacacgcatgtcagccaggacacgctgatcgagacgtacatcacctcgcatccccgtgcgaagtagtgcagcgcgcaatctactcggcgcattacactgatatgcagtgagtgaacgcggcgtttgcatggggcaaatgcgggcgctcttgtgttattgaactggtaaagtgaacgatatgcctaccgatctgcttggacgtgaatacgagaccttcccggtgccggaaccattgcggcagcatggtcccgcacgggtcattgccatgtgcaatcagaagggcggcgtaggcaagaccacgagttcgatcaacatagccggcgcgctcgcccagtacggcaggcgcgtgctcatcgtggacttcgacccgcagggggcggccacggtgggtctgggcatcaatgcgaacgcgcttgagaacacgatttacacggcgttgttcaatccgcgtatggatgtgcatgaggtgattcagcacaccaaattcgatgggctcgacatcattccggcgaacatagacctttccgcggccgaggtgcagctggtcactgaggtggggcgcgagcagatcctcgcttcggtgctccggccgatcatcaacgaatacgacgcgatcatcatcgattgccagccttcgctcggcctgctcaccgtgaacgcgctgacggcagccgacggcgtgatcattcccgtcgccgccgagttcttcgcattgcgtggtgtggcgctgctcatgcagtccattgagaaggtgcagtcgcgcatcaatccgtcgttggagatctacggcgtgctcgtcacgatgttcacgcgtacgttgcacagcgacgaggtgctgcagcgcatttacgaggcgttcggcgacaaggtgttccactcggtgatctcgcgttcgatcaagcttcccgacgccaatgtggccgcagcgccgatcacgttcttcgcgcacaaccacaagacggcgaaggagtaccgcgaggtcgcccgcgagatgatctaccgcgacatcgtcgcctgattccactttccttcccctccacttttccttcttctcttttttcattgtccgcgggattgtatgggcaaacagtgttccaccatgtggacacatattaatagtcatagtgactattaatgatatgcttggggtggatgcaaccgggcatgctgccatgccatagggatgcatgcgaggcagacgagtccgataggagaggtatggggtacggcaatgtgagcgaacggagattcgccccgccgcagattggcgtcacctcggtgattctggcgttggaatcggagacgcacgggcatgcgcgccgccgactctggctcccgctcgtccagcgcacccgcgaacccttcaagggaatgtgggcgctgccgggagggcggttgcaggcgaaccgttcgcttgaggaatccgcgttcgccacgctggcctccaccaccgacctgcacccgacctacttggagcagctgtacacattcggggacccaatgcgctcgagcaacggcattcccatggtgtcggtgtgctactgggcgctgctcgaccatgccgatctcggcacagagcctggcacggcgggcaatgcgcacaacgtgcgttggttcccggtggacgatctgcccgaactggccttcgaccacaccacaatcgtggagtatgcgctgtggcgtctgcgccaccgcatggatgcgccgaatgtggtacggcagctgattgccgagccgttcacgcttggccagttgcacgatgtggtggaggcggtgctgggtgaggagatcgatctggcgaatttccgccgcaagatgctcgcctcgcacacgttggaagacaccggcgaggtggcacgggagggccgcagacggcctgccgcgctgtatcacttcgccgaccatgccgaggaggagggcttcgccttcttcgccgagcatgtagccgggaacccgcatggtgcttgcgaagctttgcaggtgaatacgcctgacgacgcgctttccgccctcatgccgcatgcataggcatcgcatccaacacaggacagagcaacgagaacacagagagaagaaaccgaggagtgctatgaccaccgcggaactgggcctcggcgccgcaacgccgatcgacggcccctcaccggagcgcgagccgctcgccaatgccgaagcgaccacgctcacacgcaacgaacgactcgaccgcctgccgttcaacaaggcgcatcgcaaactgctcatggcgtcgggcatcggttgggccttcgacgccatggatgtgggattggtgtcgttcgtcgtcaccgccatcgccgccgacccgcatttcaaccttgacgccacgcagaagtcatgggtgctgtcgatcggcttcattggcatggccatcggcgccgcgctgggcggtttcctcgccgacaagctcggccgcaagacggtgttcaccgccacaatgatcgtgttcggactcgccaacggtgccatggcattctcgtggacgctgctcgcgctcttggcggcacgcttcgtgatcggcctcggtctgggcgccgaactgccggtcgcctccacgctcgtctccgaattctcgccggccaagcagcgcggccgcatcacggtgctgctcgaatcgttctgggcggtaggctggattctcgccgcgatgatcggctatttcgtgattccaaacaccggcgactggggttggcgttgggcgctgctcatcggcgccatcccgctgctctatgcgattgtcgcgcgccgccacctgcccgagtccgtgcgcttcctcgaggcccgtggcgacaacgaacgcgcagaggcctccgtccgctacttcgaacaagcctcgggtgtcgccgccgtgccatcgaaacccgccaggaaactgggtaggattcgcatgcgcgaactcgtcggccgtaaatacctcggcatcacgctggcgatctgggccacctggttcttcgtcaacttctcgtactacggtgcgttcacctggatgccgtcgctgcttgcagaccagttcggctcgctcacgaagtcgttcggctacacgctcgccatctcgatcgcgcagctgcccggctacttccttgccgcattcctcgtggaacgttggggccggcgcaagacgctgagcgtgttcctcgccgtctccgcgctcgccgcgttcctgttctcgcaatccgcaacggtggcgcaggtgctgtgcttcggcatgctgctctccgcctccaacctgggtgcgtggggtgtgatgtacgcggtgacgccggagatctacccgacccgcatgcgttccaccgcagccggtgcagccgccgccgtgggccgtatcgccgccatcgtggcgccgcttctcgtgccgtggttcctcacgatgtccggcggcaacaagtccgtcgccttcatcgtcttcgctgtcgccttcgtgctcgcctgcgtcgccgcgctgttcctgcccgagcgtaccggtgaatccctggaggattaatctgcagacttggtcgttccttgcagactgtgtccactgaacgaccatagttcatgccaactttggtcgtttacctgacaacaatgtgggtaaacgaccttttttgtctctactatggtcgttctatggacagattgcccgctcaacgaccatatatgccaagctcggtcgtcgacgtgcagacagactggtgaaagatatgccgagccactcctcaggcgaaataggacgaataattatacaacgctgtcacactgcgagagtacgattgcgatggtttgcgagtcaacgcaacacctatacgtatgcctgagtgtgaatcacatcataggaataatcaagagaggctttgaatggctgttcgcggcgatattcgaaatgttgcaatcgtagctcacgtcgaccatggcaagaccacgctggtcaacgccatgcttcagcagtcccatgtgttcaacgagcgcgaggaagtgccggaccgcgtcatggactccaacgacctggagcgcgagaagggcatcaccatcctcgcaaagaacacggccgtcgagtacaccggaccgcttgccgagaaatacggtcacccggagggcatcacgatcaacgtcatcgacacgcccggccacgccgatttcggcggcgaggtggagcgcggcatctcgatggtcgacggcgtcgtgctactcgtcgatgcctcggagggcccgctgccacagacccgtttcgtgctgcgcaaggcgctcgaggccaagctgccggtcatcctgtgcgtgaacaaggtggatcgtcccgacgctcgcatcgaggaggtcgtgggcgaggcctccgatctgctgcttggcttggcgcaggatgtgatcgaggagggtgtggacctcgacctcgactcactgctcgacctgccggtgatctactgcgccgccaaggtgggctatgcctccgagaaccagccggccgatggccagctgcccgacaacgacaatctggaaccgttgttcgacgcgatcatcaagaacatcccggcccccgaatacgagccgggcgcaccgctgcaggcccatgtggcgaacattgactcctccgacttcctcggccgtctcggtctcgtgcgcatctacaacggcacgctcgagaagggcaagacctacggcctgtcgcgcgtggacggctccatcgagaacttccgcgtctccgagttgctgcgtactcagggtctcgaccgtctgccggtcgagtccgccggtcccggcgacatcgtggctgtcgcgggcgtcaacgacatcatgattggcgagacgatcgtcgatccgaacgacccgcgcccgctgccgctgatccacgtcgacgacccggccatctcgatgaccttcggcaccaacgactccccgttggccggcaccgagggcaaggaccacaagctcaccgcccgcatgatcaaggaccgtctcgaccgcgagctcattggcaacgtgtcgatcaaggtgctgcccaccgaccgcccggacgcctgggaggtgcagggccgcggcgaactggcactggccgtgctcgccgagcagatgcgccgcgaaggcttcgagctcaccgtcgggcgcccgcaggtggtcaccaagaccatcgacggccagctgtgcgagccaatggagaacacgacgatcgacgtgccggaggagtacatgggcaccgtcacgcagctcatggccgcccgcaaaggccgcatggactcgatgtcgaaccacggttccggctgggtgcgtctgcagttcaccgtgccgtcgcgtggcctcatcggcttccgcaccgcactgctgtcatccacccgcggcaccggcatctcgtcttccatcgcggccggctatgcgccatgggctggcgagatcgtgacccgccagaacggctccatggtctccgaccgccagggtgtggccacgccatacgccatgcagcgtctgcaggcccgcggcaacttcttcgtggaaccgcagtcgccggtgtatgaggggcaggtcgtcggcatcaacaacaagccggacgagctcgacgtgaacatcacgctcgccaagcacatgacgaacatgcgttcctccaccgccgatgtgctcgagacgctcaccccgccgatcaagatgagcctggaggagtcgcttgacttcgcaaacgaggatgagtgcgtggaggtcacgcccgaatcgatccgtgtacgcaagatcatccttggccgtgaggattggtacaagtggcgcgccaagcagcgtcgcgccaacgcgcagcagaacaacaagtgatgccggcgatgcgcatgtgatcggaatggagggcggtgcaagccgccctccatcgcatatgcatatatgtgcgtgccctgaaatcccgcgggacgcctacgatggagccatgagccagaacacgaacgtcaccgaatacgtcacggcgggcgatgatgcgcaggagtccgcgctgccatggagttacaggcagcggccgtggctgcgttacctcatcgatgtggtcagtggcgcggcgctcggcattgtgggaacatttgcgcaccgcatgggtgccgcgcagaacatcccatacggcttggtgctggcgttgctgctcgtggcactcggtgcatggagtgcgcgcagcagggatggcgtggccggcttcgcattgtatttcatcgccagcaccacggtgttgtatttcctggcactgcgttcgggcgacgtactcatcgctgccggattcgcctcggattcgctgccattctggtcgcagcatgcgggctacagctggctgttcggcgtcgttgtcgtgcagttgctactgctcgtgttcccgaggagattcttcagcatgccgacgcgacgtgtgggcagacgcaaatccgagaatgactccggcacagacgactgacggcaggtaggtgagggaatccatgacgcggcaatccacacgcatccattatctcggcccgcagggttcgttcacgcatcaggcggccattgagtctgccgccgaggcatcacgtaggctgcatatggacgtcgcggatttcgaattcgtcgcctgcgacacggttcctcagatcctgcatgcagtggagctcgggcagggatggggcaccatcgcctgggagaacaatgtcgagggattcgtggttcccaatctcgacctcatgatggacgccgccgatgccgccggtttcctgcgcgtgggcgtgaatgtgcgattcgacgcattcgtcaccgagcgcacctaccggcatgcgtgcgaacaatatgccagtgagatcgccgtcgacgatgcgcagattcccgcccgcgacaatgcgaatgcctatggtgccgcctcaacgccgcccacgattgacgagcttgcgattcgcgattgcaccgcggtctgcgcgcattcgcacggactcgcacaatgccggcgattcgcgcgcgagcatggactgaaaccggttcccgcagcatcgaatgccgccgcctgtcgcgatcttcaggacttccagattgcattgggcccctcgatctgtgccaacatctacggtctgcaccgcgtggcggccaatgtgggagatttcgacggcgctcgcaccgagttcctcacgatcgccccgcgcagtcaggtggtggagcggttgcgaatcccacgtagcgatccgaagactgaatttgaatcggtcatcgcgttcattccgctggtgacggggcccggtgtgctcgcgaatctgctcgacgtgctgcgcgacgcgcaactgaacatggtgagcctgatctcgcggccggttaagggacgcgacggcacttacagcttcctggcgacgctcgacgcggcaccgtgggatgaacggttcgtgaacgcactggtggagatatgtgagcacggcgactgggtgcgcacgctggcggtctacccgcgagacgagcgtaactacccaacggtctcggaatggatgcttcctgcaggtggagtacgatttgaaggtgaaccccacatggcgaattggcgtgagagcgcagatgtgcgaaaggaattgctgtggtagagcgggatatgcacgaggagacgatcaagcagtgggatcgcgacaacgccggcgaaccccaaatcgcaccggagggcatcgaatgccccaagcatgtcgccatagtgggcctcgggctcatcggaggttcgctggcacgccgtctgcgtgagtccggctgccatgtgagtgcgtggaatcatcgcgatcacccatatgcgaacgctcgtgcggccggcatcgattgcaaggacacgcttgaggagctggtggcggaggagccggatgtgctcatgctgtgcaatccgctcgtggcgatgccgcaggtgctgcagacgatcaaaccgatcatcaatccacagaagaccacgctgtccgacgtcggttcggtgaaggggcccgtgcgcacacaggtaagcgaagtcggtctgcttgactgctacgtgggagcgcatccgatggccggcaacgagcattctggctgggtggccgcagaccccacactgttcgatgacgcgctgtgggcggtcacattcggtctgcacacgcagtaccggcgcgttgtgcagatcgccggcatgatcacacgcggcgtgcgcaacacgatgatcgtgattgacgatgtgacccatgaccgcgaggcgtcgctcatctcgcatatgccgcatgtgctgtccacggcgctcatcaacgagatgacgagcgatgcgaacaacgccatcgcctcggcactttctgccggctcttggcgcgacatgacccgcgtggcattgaccgacccggatcgcacgcgtgccatggtggtcgagaacgcgcataatgtggaggaactgctgcatcgcatgatcgattggctgagcgagttcgccaatgccctgcatgaggaagacgagaccgagattcgccatttcttcgccgaggggcagccatatcgcgactacaaggcgcagatcaatgcggggaaggtgagcgacagcaccgagaccatcttccagtcgctgcgcatcgaccctgagcattggcgcgaacagctgctcaaatccgcccaacggggtgagtacattgtgcgcttcacctccgggcaccgcctgatcgccgagcagcatccgagcattcgctcctgacgtgttgctggctgctcatctacgggcagccgggcgctctggcaccggtttgagaatggcgatgtcggtcgccgatatatccacgtcctgtgcgggtctgctgccgttcgccgcggcatcgcgcgtcagctgcagtgttctgccatcccacgcacgcacatggcccacatagtcacggtactggtgtcgaccagtgtactcgtcgacgccatcggtgatgcgcacgaccacgcgcgctcccaccgggattcgttccggcaatctcattcgcgctccttcccgaaaacgatgccctcccaacatgcaacgctgcgcagacatcgtgccatggccttcggggagtgcatataacggctgggcccggccaatcgtgcgattgaccgggcccagccactgctgaccgggtttccgtcactcgctggcgactgcgttgagcacggggtgcttcagcgcgcgccttgccggcgagatgctggcgatgaggccgacgaggatcgcgacgatgaggaacagcacgagctggtcccacgggatcgtcaacgtcgtcatgccctgcgactcgtaggctatgcgaatcacgacgccggccgcgacacccacgacgatgccgaccagtgtgccgaacaccgagaggatgaccgcctcgatcgcgagcatgccacgcacctggccgttcgacgtgccgatcgcgcgcagcaggccgatctcctttgtacgttccgacacgttgagcgccaacgtgttgacgatgccgaagatcgcgatgatgatcgacaatgcgagcagcgcgtagatgatcgcgagcatcgagttgatcatcgagctcatcgacgacttgaactcgtcgcgtgtgagcaccgagatcgtgtagaacggcttcacggccttctccaggttcttgccgagtcgctcgatgttcgcgccgggcttcgcctgcacgtacatctgcgtgaccatcatcatgtctttgctcgtgagcctctccgcagtcggcagcgagatcatgatgccgtcggagtacagagcgtcatcgacgattgcgccgattttgacctgctccttcttcgtctcggtcttcatcttgacgaactgcttcgggtcggtattctgcgcctgcttgacgatgctctccgcctccttcgctttgctctgagcgccggagacgtcgcccgaggaggcaagccgctgcgcttcctgctgcagtgccgtcacttgggattcgatcttcttctggtaggcttcgtacgcctgcttcgtggcctgttcgtcgaccgatgtgttttcggacttgagatcaatcgtgtcaccgattttccagtgctcatcattggcgacggtacggccgatcacggcctcaccgttctcgatcgccttcgcggcatcgccatcctgtcgttcgaccggtgcgatcttcgtgaacagatcgaccttgctcgtggtcggcatgatggtcttcgtggcgttcgtcaccttcaccgtgggcagcatggagacggccgacgaggcacccacgccttccgtgtcctcgaccgcgtcgacggccttcgtggagatcggttgcgtcatgctcgccgccatgaccacgtagtccgcgttcacgttgttgtcgacgaggtcgctcaccgaggtcttcatcgaggatgcgacgacgccgagacagctgacgatcgcgacgccgatgaacagcgcggccgccgtgttcgcggtgcggcgcttcgcgcggccgatgttgcgcgtcgcgagcttgccggtgaccgggaacgccttcgacgggatccagccgagcactttcgcagcgggcgcgacgaacgccggcgcgcacacgattgcgccgatgacgacgaatgccgcgccaaggccgagcgtccagccggaaccgaggtccttgagccactgccaatcaacgcgtttgtccgcatcgagatagcacagcacccagaaggctgcgccgacggcgaccatcgcgatgccaatccatccacgtgccctgaccggcttctccggattgaccgtctcgttcatcgcctggatcgggggagcggtcgccgcggtcttcgctggcaatgtcgcgccgatgatcgtcacgatgacgccgacgatgacgccgacgatgacatcggtcgccgaaggggtgggcgagccggacagcggcatgccgctttgcgtcatgcccttcgcgatcaattcgagcagaccccagccgagcagcacaccgatgccggagccgaccaggccgaggatgacagcctggatgagcacgcttgcgaacacctgcaacggcgaggcgccgaccgaacgcagcagtgcataaccgcgcatcgattcgcgcacgatcatcgtgaacgtgttcgcgatgatgaacgcgccgacgaacaacgcgatcgccgcgaagatcaggatgagcggctggatgaagccgagctggtcctggatgctcttcgtcgcgtcgtcacgcaccgagtcgccggtcacggcgtgcgcgtccgcactcttcggcagtgctttgttgatgcggtcggcgagttgctgctgggcctcctcgtcgagcggcgtcgtcttgctgccgtacacgccgatgaactggatgctcgaggtgtcctctccctcctcctgcagcacatgctggacgaaactcgggcgggcgagaatgaggattgcgccgagctgtgtcgacggcgaagtgaagacaccggagacggtcatctcacgtgcctcgccgtcaacgatgagtttcgccgtgtcgccggtcttgagcccggctttgtcggccgtgtcttcaagcagcgcgacctcatcgtccgtctgcgggtattcgcccgagacgaaatgcgccgaacgccatggggcgtcctgatcgacgccgatgacgagcgtcggtgcaccgaccgtcgtcagcgcgtcgccgttgtggtcgagcagcacggcgttgcccagctgcatcgtcgcatcggcgctcgcgacgccgtcgacattctcaatgtcggggatgatgcttgtgctgatttcgttgtatgtgctgttgtagctggtgacactgccacccggctcctgcttctcctcggtcgcgccgcgcacatagacgtcggcgtccgaattcgatcccatcatctgcgagacttggtcgttgagcatctcgcggaagcagaacgagccgacgacgaacgcgacgccgagcgcgatcgcgatgatcgacatgatgaagcgacggaaatgcgccttggtatcccttaatccgatacggaacatcgttggctcaggcctccctggctgcgggctcgacgtcgaccgggccgttgtccgggtcgtcgtgctcggcgaagacggcgaggatgtcgtcgtaggtcgggtggtccatatcctgcgtgatcgaaccgtccgaaagcacgagcacgcggtcggcgaagctcgcggcacgcgggtcgtgtgtcaccatgacgatcgactggccatagtcctgcacgcattggcgcaggaagccgagcacctcgcggctcgaacgggagtcgaggttgccggtgggttcatcggcgaagatgacgctcggacgttccatcatcgcgcgggcgcatgcgacgcgctgctgctggccgccggagagctggctggggcggtggtcgaggcggttttcgagccctacgacgccgacgactttcctgaaccagtcgcggtcgaccgggcggtgcgcgatctgcagcggcagcagaatgttctcctcggccgtcaacgttggcacgaggttgaaggactggaagatgaagccgatctctttgcgccgcagttgggtgagctgcttctgcttcattgacgagacctcgaggtcttcgacgaacacctgtccgctcgtcggcacgtccaatccggccatgcagtgcatgagtgtcgacttgccggatccggacggccccatgattgcggtgagctcgccgcgctggaattcgacgctgacatggttgagcgccgtcacttggctgtccgtatcgccgtaggtcttgaccagatcgactgcgcgggcgacgaccgggtcgtcaggatttgtgactgtgcgggcttgtttgctcatggaaacctttccaccgggcttgcgtcgcccggtatccgatgggtgggatgcgccaatctgcatatgtgcatggcacggcgcgatatctgccccgcaaaacggcgcaggccccttcatcttcactgcacgaccgctccatatgagtcgaatatggtcatggatgagggtcgtttgcacagaccacagtaccggaagcagggtatgctggatcgcacaatctcacgagatggaaggtgccatggatgcgcaagtgctgatggagcgattcatcgaatatctgcgctccaaccggggactcagcgagcacacctgcatggcgtaccgcggcgatattctgcagtgcctggaagcgctcgatgccttcggccgtgggaatcccgacgatgtcacgcttgacgacctgcgcatgtggatggggcgcatggcgcataccgtgggcaagacgtcgctcgcccgcaaaacgatagccgtccgtagtttcttcacctgggcctatgagcatgggatgctcgcccacaacccggcgcatgcattgcgcacgccgaaaatcgacaggaacctgccggccgtgttgaacgaggaccaggccgaacgactgatggacaccgtggatgccgaagcaggggagaagaacgcgggcaagtcgaaggacgacgccttgaacgctcatgcaaaggcgctccgtgactgtgcgatgctggaattgctgtatgccacgggtatgcgtgtgggcgaactcgtgggattggacatgggctcgttcgactggtcgaaccgcacagtgcgtgtactcggcaaggggaacaagacgcgagtcatcccgttcggggctccggcacaacaggcagttgagcactggctgcacgggggaaggccggtattcgcgaatgggaacagcggcaacgcggtgttcattggtgtacgtgggtgccgcatcgaccagcgtgtggtgcgtcaggtggtgcatgagcaggccgagcaggcgggggtgcctgacatctcgccgcatgcgttgcgccattccgccgccacccatatgctcgacgggggtgcggatctgcgcgaggtgcaggagatgctcggccattcctcgttgcagaccacgcaacgatatgcgcatgtctcgatcgaacagctcaaggaccgctataggcaggcctttccccgagcatagggcgcattgccccggaccgtcggcgtcacttgttaacacatcggtaacaatgtagcggcgtacgcctcccacgtgaattgacggggattcgcggcaaatgcgcgtattgcaacgcatgcgcaaatgagatgtatcgatggaatgaatctgctgcggattttgatttgacgggaggtgtggcaataatgatgggtaatcagcaacggggttgagggtcccaccttcagccccgctgctattaggcgagtattcgtctgcatatgaataggagataccatgaagaagaagacactcggcctcatcgccggcatctgctcactgggcatgatgctgagcctgagcgcctgtggttccaacggcggcagctcggccaagggctccggcgacaacatcatcaccgcatacaactccgagccgcagaacgcgctgatcccaggcgacaccaatgagaccggcggcggcaaggtgggccagctgctgtttgccaacctcatcgccttcaatgccaagggcgaggcggagaacgaggtcgccgactcgatcaagccgaacgccgactctacccagtacacgatcacgctcaaggacggctggaagttcaccgacggcacgccggtcaccgccgagtcgttcaccaaggcctggagctatgtggccaatgcgaagaacgcccagaagtgctcctccttcttcagctcgatcaagggctacgacaagctgcaggacgccaactccctcaagggtgacgagcagctcgaaggcctgaaggtcaaggacgacaagaccttcaccgtcgacctcaacgcgcctgattcggtgttcccagtcaagatcggctacctggccttcgctccgctgccggaatcgttctacaaggacccgaaggccttcggcgagaagccggtgggcaacggcatgtacaagctcgacagctgggatcacggcaagcagatcgtgctctccaagaacgccgactacaagggctcgcagaaggtcgccaacaacggcgtcaccttcaagatctacacttccccggactcggcgtacgccgatgtgcaggcgggcaacctcgatgtgatggacaccgtcccggcctctaacacgaagaccttccagagcgatccggatgttgagccttacaacaaggccggctccgtgattcagaccttcaccatcccggctgacctcgaccactggaagaccggcaccgaggaaggccagctgcgtcgtcaggccctctcgatggccatcaaccgtgagcagatcgtcgagaaggtgctcaatggcatcggcaccgtggccaccgacttcaccgcaccggtgatcccgggctattcgaaggatctcaagggctccgacaacctcaagtacaacccgaccaaggcgaaggagctgtgggcgaaggccgacgcgatctcgaagtacgacggcaagctcacgttctcgttcaacgccgatggcggcgctcagccgatctacgaggccgtggtgaaccaggtgaacaacaccctcggcatccaggcctcgatcaacccgatgccgaccttccaggagttccgcgacgccatttcgaaccgcacgatcaagggtgccttccgcaccgcttggcagcctgactacccgtcggccgagaactacctgtaccagctctacgacaccgctgcggccaatggtcacggctccaacgacggcgactactcgaacaaggacgtcgacaagctcctcgatcaggcagcttcggcgaccgatcaggaaacggccatcaagtactaccacgatgccgaggagatcctgctcgaacagcttccggcgttcccgctgtactattccaatgcggacggcgtggcagccaagggcgtcaagaacttccagatggattggcagaaccagcccatctatgaagagatgtccaagtgatgtccaggtgatgtccaagtgatgctcaatttgttcacaattgtgtgagcacatgagccaccatccatgggaagagggcgaaaccattggtttcgccctcttcttgtatttcggttgcaggcagaaggccactgtgatttacgtggcgggccacacctcccatagcccatatggggcatcttcttctcgacgtaagtcaacgcatgcggtaaactaggcacgaactgaataaccgatgcaaccgctggcgtgtcgagttcgccgcgttgcaccggcattgaatttgcaaggagaaaccgatgggcaagtatcttctgcgacgtattctgcagatgatccccgtggttcttggtacaacattgctggtatacgcgctcgtattcgcgctgccaggcgatccagtcaaggcgatgttcggcgacaagccagtcaatgaggccgtcgcagcccagatccgcagtgaatacaatttggacaagccttttattgtccagtatctgttgttcctgaagaacgcattgtcgctgaacttcggcaacacattcgccggccagccagtgatcgacgagataagccgggcgttcccggtcaccttgaagctcgccctcatggcgttctgcttcgaggcgatcttcggctgcgtgttcggcgcaatctccggcctcaagaaaggcaagtggtacgattcggtcatcctgatcgtctcgctgctgctcatctcggtgccgaccttcgtcaccggcttcgtcggccagtacttcctcggcgtcaagggacacatcttcccggtgacggcgggcgcggaccctggcttcttcgacctgctgctgccggccatggtgctcgggtcggtttccatggcgtacatcattcgcctggcccgttccgaaatctcgtcgaacatcgcacaggactacgtgcgcaccgcccgtgccaagggcatgagcaacaccgcggtcacgttccgtcacatcctgcgcaattcaatgatcccggtggtcacctacctgggtcaggatctcggcgcactgatgggcggtgccatgatcaccgagcagatcttcaacattcatggtatcggctatctcacctatcagagcatcctcaaaggcgaggcgaatctcgtggtgtcggtggtcacattgctcacgctcgtgttcgtgatctgcaatctcattgtcgatatgctctacgcggcgcttgacccgcgcatccgctacgtgtgaaggagggagggacatgactgacatcaccaacaaaccgttgcctgggcaggagcgctttgtcgcccccctggatgagaccccgctgctttcggtggacaatgtggatgaatccgcaccggccacgagcatgtgggccgatgcgtggcgtacgttgcgcaagaacccgatgttcatcatctcgggaatcgtgatcctgttcatcctgttcgttgcgatcttcccgggggtgttcaccaggacgaacccgaactactgcaatctcgagaattccctcgacggctcccagccgggccaccccttcggcttcgacctgcagggctgcgacgtctacgcccgtgtggtctatggtgcacgcacctcgatcagcgtcggcgtgctcaccacgatcatcgtcgtggctgtcggcacgctcatcggtgccatcgccggcttcttcggaggatgggtcgatgcggtgctgagccgtctggtcgacatcttcctggccatcccgatgctgctcggcgccatcgtcgtgctgcagatgttccgtacgagctcgtcaatctggaaggtcgtgctcgtgctggcattgttcggatgggtctcgacggcacgtatcgcccgcggcgccgtgttgagctcgaagaacctcgagttcaacaccgcctccacggcgctcggctccacgccgatgcgcaatctgttccgccatattctgccgaactcggtggcaccgatcatcgtcatcggcaccacgtcgctgggctcctacatcgtctcggaggccacgctgagcttcctcggcatcggtctgccgccgagcgtggtgagctggggcggtgacatctcgaaggcgcagaccgtgctgcgcaccgacccgatggtgctgttctacccgtcgctggcgttggccatcactgtgctcgcgttcatcatgatgggcgatgccgtcaaggatgcccttgatccgaagagccgtaccgcatgagcgcacaggagacatcgatgacaaacgagacacagtccaatcaggagacgatcgaagagaagatcgaggacatgcagcatgaggtgggcccgctgcttgaggtcaaagacctccaggtggacttcaccaccgatgagggcaagccgatccacgccgtgcgcaacagctcgttcagcgtgtacccgggccagtgggtggccattgtgggcgaatccggctccggaaagtccacctccgccatggcatgcctgggcctgctgccgggtaccggccatgtggtgggcggttcgatcaagctcgaagggcaagagatcagccaatactcgcccaagcagttcgcttcgatccgtggttcgaagatgggtttggtgccgcaggacccaatgagcaatctgaacccggtgtaccgcatcggcacccaggtcaaggaggcgttgacggccaaccatatggacgtcgcccacgagaagcgttcgaacctgtcgaaggcattggcccaggccgacatcacgatcaaaagcgagggcgatgagaccttcctcggttccaaggagctgcctgagctgctcgaagcggccgggcaggccctggtcaaggccggtgtggaaggcggcaagtacgagaagcgcatggcgtatttccgcgaggagtgggtgccgggttccgaaacccgctggcgtgttgccgacgacctcatcaaaagcggtgtgaaggatgacgacgcttggtacatcgccaagaaatacgtcaccggttccacgatgaccgaccgcatcgcgggcctgctcgatgaagcaggtctgcccgatgccgccacgcgtgcacgccagtacccgcatgagttctccggcggcatgcgacagcgtgcgcttatcgccatcggcttggcatgccgtcctgagctgctcattgccgacgagccgacctccgcccttgacgtgaccgtgcagaagcgcattctcgaccacctgcaggagctcacgaactcgctcggcaccgccgtgctgttcattacgcacgatctcggcctggccgccgaacgcgcccagcatatcgtcgtgatgtacaaggggcaggtggtggaatccggcccctcgctcgaagtgcttcagaacccgcagcacccctacacgaagcgtttggtggccgcggccccatcgttggcctcgcagcgcatcatctccgtggaggagaagggtgaggacgccacctcgctcatggatcacaaggtggacgaagacaagctcgagcatagcgacgtgatcatcgacgtcgaccatctcaccaaggaattcaagctgccgcgacgccgtgagatgttcaaggccgtcgacgacgtaagcttcaagattcgtcgtggcaccacgctggccattgtgggcgagtccggttccggcaagtccaccgtggcgaacatggtgttgaggctgctcgagccgacctcgggcaaggtgctctacaacggtcaggacattcaggagttcaagggcaagagcctgttggatttccgccgtcatgtgcagccggtattccagaacccctatggctcgctcgacccgatgtattcgatttaccgttccatcgaggagccgttgcgcatccataagatcggcgacaagaagagccgcctcaaccgcgtcaaggaactgctcgacatggtggagttgccggagtcggtgatggcacggtacccgaacgagctttcaggcggtcagcgccaacgcatcgccatcgcacgagccatggcgctcaaccccgacgtcattgtctgcgatgaggccgtctccgccctggatgtgctcgtgcaggatcaggtgctgcatctgctcaacgacctgcaggccaagcaggggctcacctacctgttcatcacgcacgatctcgccgtggtgcgtcaaatcgccgacgacgtggtcgtgatgcagcatggcaagcttgtagagcacgacaccaccgacgaggtgttcctgcatccgcagcagcagtacaccaaggacctgcttgacgccatcccgggcggcaagctcgagctcggtctcaatcttgaagacaaggcctgagcaatcctgaacatacacaacgacccgctgcccgcataatctgcgtgccgcgggtcgttgctctatgggcctctgtctctttttacgcaaacgggagtgcatacggttagttgcgtaatcggagacaatttccttaccggaactgtctctttttacgctgattacgctgaggggcacttgcacacaaggtgttcacacacgagataatcatgcgtaaaagggacagattcttgcttaatctgtctccttttacgcaagtctattcctcgacatcctcgggttcgtcgagggagccctcggaatcatctgcatcatcggtatcgggaaccagcttcgtgccgagcggctgtgtattgatcgcataggcggccatatggtgcgccttgcccaccttgtgaatcgcgtccatgatctcgaatgcctgcgcgaagatgatcagggagaagatctcgtgcgagacctcgctggtgagtacatcgccgcctggcagatgccccaatagcacgaacacgaagaacagcgtggggtagatgagctggcgttggtaggtatagaagaattcgcggtcggtcaggtggtagatgatgatcggcacaagattcaggcatgagaatatgatctggatgatcagcagcacgcccacaccctgattcatcttcgtgaagaacacggtggagaatgcgcccagacagacgatcacatagatgttcgccccgacgagataggcgaactgcagtgtgcgtgtattcgtgaagaagccggcgaggaacacgcagaatactgagatctcgatgaacacgtccgcatagaactcgcttttgtcgaacagcgagatggcggcgccgaccaccatgagcacggcgagcgcaatgaagagcttgaatccacgcggcatgggcagcttggcggcaggggaatcggttggtttggtcatatccactcccagtaatcgaacagcacggcgatggcgggtgtgggcatcgcccagctcacacagtagttcgttgggagcgggacgaggggactttcatatgtcagcttatgtgaaacaccgcatgaaacctgttcgccagaaccatatgttgcgcgcgctggtaggctttaagcatggctttgacaatcacaacctcgaatctgaacggcatccgtgcggccaaacgcaaaggattcgaccactgggcgaaggcgcatacgccgaatgtctggtgcatgcaggagacgcgcgcgcctcaggagatcatcgccgacatctacggcgagctcgcggcggactatgtgcatgccggcaagatcgcgtcgccggaggaactgcatacgctggtggacgtctgcagaatcaaggggcgcgccggcgtgggcatgatcagcgacatgccggtgctcgaaacacgcgtgggattgcccggactcgaggaagacgtggattcggggcgctggatcgaggcggatgttcgcaccgaacaggggtatgtgatcaccgtcgtgtgcgtgtacgtgcatgcgggtggcttggtggacgacccgaaggaggcgcagaagtaccgtttcctcgacacgatgaccgagcgcatgcagcagttgcaggatgaggcggcaagcggtggcaggcaggccgtggtgtgcggggacttcaacattgcgcataacccgatcgatctgaagaacccgaagtccaatgagaacaacaacgggtatttcccccgcgagcgcgcctatatggacaagtggatcgaccagatggactacgtggatgtgatgcgtgatctcgccggcgacatccaaggcccctacacctggtggtcgcagcgcgggcgtgccttcgacaacgattccggatggcgcttggactaccaattcgccactcccgaattggcccagcaggcgcgcggctttgtggtggaccgcgcatcgtcgtacgacagccggtggtccgaccacgcgccgctgacgatcagctacgacgtatgagaggcgcagcgtgcagggtcgatgtgtgtggattgggcgtgggatggcctgatttgacgtgcattgccagtgcgcgtgctagtgttggacacagcttattcaccgattggtatacgtcttgcatggaggcatgatgggcttgtttggattcggcagaaagaagaaaaagcagcaggatgacgagcgtctggccgaggcggtggactcgcggaccgaggacgtcgccgtcgaagacagcgaggacgacgagcagactgaggtacttgagggcgcccgcaccgaggtcggtgtcgactatgagggccgtggcgagacggtcggcccgtgggatgtggatgacgcgaacgcccccgattacgacgagtacctctcacttggcgcctactatctgccattcgtgcagggcatccaattgcgcatcaaggcgaacaacgccacccatgagattgtgggggccacgatgacgattggcaattcgagcctggaggtcgaggccttcgccgccccgaagacgatgggactgtgggacgacgtgcgcgaggacctgctggcatcgaatccggaggccgaggccgtggacggcattttcggcaccgaggtgaagctgccggtcaagctgccgaatggcaagacggcccacactcgcatcgtcggtgtggacggcccacggtggatgctgaggggtatcttctccggcaaggccgcctccgaccccgacggcaccgagacgaagatcctcaacgatgccttcgcacagattgtggtggagcgcggcgatgagccgttgtcgccgcgcgaccccattccgatggcccgtccgctgacgccgaatgaacgccgtgcgctcgccgcccaggaggaggatggcgatctcgcaggcgatgaccactcgaagatccccggccgtccggatggcccgttgtccactgatcagcaagtggagcagcagaccacgttgcgccgaggcccgatgttctccgaagtgcgctgagggcacctagcaacgcctactcatctcatctatccgacatttacggaccaacacccacgaacgaggtcatgagcaaccagaacgagcgacacgcttccaacacccggccggcacgcgcacgaagcggcatggcggcactggcgaatgcgggggagaacgacgagttctcggtgatcgccgccataggtggtgtacgtggcgtcgtggaatcgatgcttccgggactcctgttcgtcgtgctgttcatctgcacgtcggatctgcgtatgacggtcatcgcctccgccgcacttgccgtggtgcaggtggtcgtacgcctcattcaacgccagtcggtcatgggcgcgttgggtggtctcgtcgccgtcggcatatgcctgttctgggcgtggaagagcggcgaggcccgcaactactacatgtatgggttcattacgaacgccgcctacattgtgctgctgctcgtctcgatggcggtacgggtgccggggctcgggttcctcgtggagttcatacgatcgctgcccaccgagcatttcaaggcttggctcagcggctggcgcagtgacagggcgctctacaaggcgtatgcccggatcacatggctgtggataggcctgttcgcgttgcgcctcatcgtgcaggtgccactgtacatgacgaatcaggtggggtggctcggcaccacgaggctggtcatgggcattccgttctgggcgctggcgatctggatctcctacctcatcgtcgccgacccgttgcaccgtcaccgcatgctcgagaaggagcgggaatccacaagtactgagggcggcgacgcacatccgactgcccaatagcagcggcacatcgacagtgggccatgggggagtccggcaataccgggctccctcgcgtatgtatggcatgcggtactcttaagttcgtttggtattgagcggaaaggcggaatatggaagccacggtggacatcgagcgatatgcggatcagggtaggtgcgtggcgcacattgacggccgagtggtcttcgtgcggttcgcgttgcccggcgaacgtgtgcgcatcgaactcgacgaacccacgaaccgcaacgaccggttctggacaggcgaggtggtggaggtgctcgaacccagccccgatcgcgtggagccgctatggccgttggcggcaccacttgcgatgggagggggagcaggtggcgccgatctcatccacgtgtccttggaaggccaggaacgctggaaggaagccaccctcaaggatgtgatgaagcgtctaggccatgtcgaccttgatgatgtgcctgtatatgcgatgccgggggatgagcaggcgcatggtcttcactggcgcacccgcatcgagatggtcaccgacgacgaggggcgcccgtcgatgcgccgccggggcacccatgtgcgggtgccgatcgacacgatgccactggcgacgcgtgccgtgctcgaggtcgccgaaatgaacggcgtgtgggacgggaatctgccggagaacgcgcagattcgcatcgccgtgcccgaaccgcgcgtggatgccgagcagattgcggatcccgaagcgttgcgcaaggcaatcggcaggaactatgcgatcatggtggacggcaaagtgcgtcacggcagccgcgcactcaaggaaaccatcatggtggacggcaaaccgttcgaatacacggtggatgccggcggattctggcagatgcaccgcgaggcgccgatggtgcttccgcagtatgtgatcgatcagattcgtgagacgcccggcgaccgtgcaccgcgcaatgggcgcaatctggtcatctgggatctctattcggggtccggcctgttcacgctgcccctcgccacactgctcgacgaccgtgccaagctcgtgagcatcgagggggcgaaggacgccgtggccaacgcgcgccggaacctgaggaacgcgggaatccacaccgtgcaggcattgtgcggcgacgtgctgcacacgcttgacaaggacatcgatcctcaacgcgcgcatcccgacatcgtcgtgctcgacccgcctcgtgccggcgcgaaggccaaagtgtgccataagatcgcgaacagcggtgcgccgatcgtcgtctacatcgcatgcgatccggcctcgcttgcacgtgacacggcgacgctcaccgaacatgggtaccggatccactccatcgcggccttcgacatctacccgcagacccaccatgtggagaccgtcgcagtcttcgtgaaatgagaggagagagcgcgtatctgccggcggtgccgtgccggtgcgggcttgtatccatggctcgtcgcggtcacaggcacgaatctgtgcttgcattcgctgagacctgctgttttcgtcatatcgctgcactttggcggtacacggacgaaaagatgcccgtattgtcgtcgtacttgcgccaatctgcgttgatttggcgaaataggacgccgatatgcgttgttctgtcgcagatttgcgcagatatgacgaaatcacgctacgctatatgcatcacggcacccgagctacgactgggtgagatgggcacgggaagcgcggcaggcgggaggaacatggcacggagaacgaaacggctggcggccattgcatgcgctgtggcggcgctggcgctgatggccggctgcacgccgaaaggtgcggcggtgggggacacgcaaaacaacgagacctatgagcacaaccacaatgagaacaccggtgcgcggctggacgtcgcggtgattggctcgccgcacggtggcgcggatgagctggtgatgcgctcgctcgccaccaaggagttcaaggcgagttacaccggtgtgcagcagtactcggcggacccgcaacgcgccgccgatttcgcacggaaggcggtgagcgatgcggtgagccgtcatcccaaggtcatcgtcatcagcgggctcaccttccatgacgacgagtcgcagtggaatacggcgctcgccaacgcgcgcaatgcgggcataccggtcgtgctgctcaatccggccgatgtgcccggcgacaccaagctgttcgccgccaccttcgtcgtcaacgatcgcatgatggacgcgcagcccatgggggaggcgttgcgttcggtgatcttcgaccatccccatgagcgcgagatcgtcgtcagcacgcgttcctgaccaccggcgtattcccctgcgtgcgtacggttgagtagactggcgaacatgagcgattccgcgaatgcacagcagagcgtatcgatgaccggtgcgcaaggtggcgacgaccatgcacatatgcccgacgtcaccgagaaggggctcaccgcagccgaggtgcgcgaccgtgtggagcgcggccagacgaacgaggtgaagtcgtcgacgtcgcgttccctggcggatatcgtgcgcgccaatgtgttcacgttgttcaacggcatcatcttcaccgccatggtcatggtgctcatcactggttcgtggaaagacgcggtgtttggcctcgtcatcctgatcaacaccggcatcggcatcgtcaccgagttgcgggccaagcgcacgctcgacaagctctccattctgatcgcctccgattacctcgtgcgccgcgatggcaaggatgtggacgtcccgcataacggcatcgtgctcggcgactgcctgtggatccgctccggcgagcagatcccgtgcgacgccgagattctgcatacctggggattggagctcgacgagtccatgatcaccggcgagtcacgcaccgtgcgcaaacaggagggcgagaccgtgtattcgggttccacggccgtctccggcatggcgctcgtcaaggtgaccgcggtcggcgcccacagttatgccgccacgttgaccgctcaggcgaaggtgtacaagaagaacgtctccgacctgaacaagggcatcaacacgatcctcaagttcatgacgttcctcgtggtgccgctgtgcatgctgctcattgtcacgcagatgcgcacggtcggcggctggcacaacgccatcgcgaccggagaatggcgccaagctgtcgtctcctccgtggccggcgtcgtgggcatggtgcccgaggggctcgtgctgctcacgtcactcaatttcgcgctcgccgccattcgccttgcccgcaagaacacgctggtgcaggacctcgactcggtggagaccctcgcacgcgtggatgcgctcaatctcgacaagacgggcacgatcaccgacggcggcatcgtgtacgacgatttcatagcgctgccgggttgccggaacaaacaacatgcgatgcaggcgctatacgacctcgccaacgaggagagccccaacggcaccggacgcgcggtgttggaggggctcggcaagcaaggcttctccggttccgcaggtttggtgcgcgtgccgttctcaagtgcgcgcaaatggagcgcggtcgcgttccacggccttcccgacgaaggccagaatggcgtgtggtacatgggtgcccccgaggtgctgctgagcggtttcgacggcgaataccagcagattctcgcgcaggtgaacgaatacgccaacaatggcaaccgcgtgctgctcatcgcccatgttcccggcggcgatgtgcctgccgatttcgaaacgaacccgcaactcgagcgtacggcggtgcccgtcgcgatcgtgctgtgctcggagcacattcgttccgatgccgagccgacgcttcgctggttccgtgaacagggcgtgcgttgccgtgtgatctcgggcgacaacccggtgaccgtgggcgccatcgccgcgaaggtgcagttgaccggcgagcgcaagcctgtggcgatggacgcacgtgagctgccgaagaacgtcgatgagctggcccgggtgctcgagggagtggacgtgctcggccgtgtgctgcccgaacagaagaaggcgattgtgcaggcgttgcacacgcaggaccatgtggtggcgatgaccggcgatggcgtcaacgacgcgctggcgatcaaggaggcggatctcggcatcgccatgggcaatgcggcaccggccacgaaggccgtggccgaggtggtgctcgtcgattcgaagttctcgcatctgcccgacgtggtggcgcgcggtcggcaggtgatggcgaacatggagcgtgtggcgagcctgttcgtgacgaagaccgcctattccgcgctgatttccctcggcgtggtgctcatgggcattcccttcccgtatctgccccgccacatcagttacatcggtgcgctgacgattggcgcaccggcgttcttcctggctctcgccccgaacacgcgccgctacattcccggcttcctacgcagggtggtcgcgttctcggtgccctgcggcatcgccacgggactttcggtgctgctgagcgcctggttcattcccagattcatgcactggaatgtgttcacctcggagcagcagctgttctggttgcgttcgatgtgtgccaccgtgctgttcctcatgggcatctacgtgctgtccagggtgtcgaagccgctcaattcatggcgtggctggctggtgctcgccttcgccgccgccggcgtgatcggcgcgtgcatcccgttcattgcgcgcttcttcgcattcgggctgcccgcggggcgcgcggtgtggatcctgttgctgcagatggccgtcgccaccgtgctgttcgtcatcagcatctgggtgttctcgcgcttcctgcccaagtggatgcgggaggcgggccgcgagaccgggattaatggcgcatctcacaatacaaacggctgaaaaagggttgacacaaacgccctgtagtgttagtggcacgcaacatccatgagatttcggaggaactatgtctctgcgcgacgaacagctggatgtcctcaaggtgggcgacaagtcgtatgactactaccgcatcgccgatcttgaaggcgtcgatcacctgccgtactcgctgaaggtgctggtcgagaacctggtgcgcaacatcgacggcgccaacatcaccgatgagcaggttcgggaattgctcgcatgggatcctgcggccgatccgagccatgagatccagttcatcccctcgcgtgtggtgatgcaggacttcaccggtgtgccctgcgtggtcgacctggccacgatgcgcgatgccgtcaagtcgcttggcggcgatcccgaggtgatcaacccccaggtgcagtccgacatgatcatcgaccattcggtgcagatcgacgcctacggcgtagagaacgccgtcgagatcaacatggacatcgaataccagcgcaacggggaacgctaccggttcctgcgctgggggcagcaggccttcgagaacttccgcgtggtgccgccgggaaccggcatcatccaccaggtcaacatcgaatatctggcgcaggtggtcatgcgcaaggagctctcgaagggcaccacgctggcctatctcgattcctgtgtgggcaccgactcgcatacgacgacggtcaacggtctgggcgtgctcggctggggcgtcggcggcatcgaggccgaggcggccatgctcggccagccgatctcgatgctggtgccgcgcgtggtcggcttcaagctcaccggatcgattcccgagggcgtcaccgcaaccgatgtggtgctcacgatcaccgatctgctgcgtcgtcatggcgtcgtaggcaagttcgtcgagttctatggcgagggcatcgcctcggtgccgctggcgaaccgtgccacgatcggcaatatgagccccgaattcggctccacctgcggcatcttcccaatcgacgaggtgaccctcgactatctgcgtctcaccggtcgctccgaggagcaggtggcccttgtcgaggcctatgccaaggcgaacaagctgtggcatgacgtcaacgatccgaatttcgtggaaccgagctattccgagtacctggagctcgacctgtccaccgtggtcccgtcaatcgccggaccgaagcgcccgcaggaccgcattgaactcagccatgcgaagaccaccttcgagcagacgcttcccggatacatcaccgagaagacgaacggcaaccctgttcccgtctccaccgatttccggggtgatttcgaattgacgaacggcgatgtggccatcgcctcaatcacctcgtgcacgaacacatcgaatccctcggtcatgatcgccgccggcctcatcgcccgtaatgcggtcgccaaaggcctcaagcccaagccatgggtgaagacctcgctggcccccggttcccaggtggtggccgactacctgaaacaggccgggctgcaagacgacctcgatcgtctcggctacgaactggtgggattcggctgcgccacctgcataggcaattcgggcccgctgctgcccgagatctccgaggcgatcaatgcgaacgacctcaccgtcaccgccgtgctctcgggcaaccgcaacttcgaagggcgcatcagcccggatgtcaagatgaactacttggcatcgccgccgcttgtcatcgcctacgctttggccggcacgatggacttcgacttcgagcatgaggcgcttggcaaggatcctgagggcaacgacgtctatctgaaagacatctggcccacgaatgccgaggtggagcaggtggtcagcggcaatgtgagccgtgagatgttcctcaacgactatgccagcgtgttcgagggcgattcgcgttggaaggggctcgatgttcccgagggcgagctgttcgcctggaacccggagtccacgtacgtgcgcaagcagaccttcttcgacggcatgagcgccacgccggctccggtcgaggacattcgcgacgcacgcgtgctcgcgctgctgggcgattcggtcacgacggaccacatctctcctgcgggtgcgttcaaggcctcgagcccggcgggcaagtatctcgtcgaacatggcgtcgagccgaagaacttcaactcatacggatcgcgtcgtggcaaccatgaggtcatggtgcgcggcaccttcggcaatatccgtctgcgcaacatgctcctcgcctcggtgggagaggaggtcaggcccggcggttacacctacgatttcctggcgatgaagccgacgaccatctacgaggcgtcccgcgactacatcgacaacggcgtgccgctcgtcgtgctcggcggcaaggaatacggcaccggttcctcgcgcgattgggccgccaagggcactgcgatgctcggggtcaaggccgtcatcgtcgaaagcttcgagcgcatccaccgttcgaatctcattggcatgggcgtgctgccattgcagttccccgagggtgagtccgccgaatcgctggggcttgacggcaccgagacctacagcatcaccggcatcaccgagctgaacaacggcgtcacgccaaaaagcgtgcatgtcgaggccacacacaaagacggctcgaagactgaattcgaggcggttgtgcgcatcgacacaccgggtgaggccgactattaccgcaatggcggcattctgcagtacgtgctgcgcaatctcatgaagtgagcattggtccgtcttatatgggaaggggcgcacctccaacgaggtgcgccccttcccatataagacgttatttcaacgcttgttcagtgcttgccgttcttccccgacattcgatccgcctcggaattcacgatggtctgcacgcgctcttcctgcagttcctcacgcctacgctgcagctggtcttccttggtgtcgggctcgcgaatgaaccccatctgggcataggcgtctttgatgccggcgctcacagcggcgcggatgatgtaatacaggacccacagtgccagccccacgacgatgatcgtgaacagactgctccacagcaatgtcatatctttctcctttgaaagagcgttcgtttggtattgcaaacgctttcatagaacagaatacaccaatctgcgcagattggaatgttctgggatgccgtggattgcaatccgtgcgtcctcggatatccttgagccagagaatgaatcccgaacccaaggaacgacgaacgccatgaccaacggaaccagtgccgacacccgcgagtacgaacgcatgctgagcggcgagctgtacatcgcagacgacccgtacctcaaggaacacagcctcaagcgtcgcaggctcgtgcaggagatcaaccgttcggactacgacgagttcgacaagcgtgaagccctgttccgtgaactgttcggcagtttcggcgaaggctcgtacatcgagccgccgttccgcgccgattacgggtgcaacacctacatcggcaggaatttctatgcgaacaccgactgcatcttcctcgacgtggcacgcatcgacatcggcgacaacgtgttctgcggcccgcgggtcagcctgctcacaccctatcacccgatcgatgcgcaggtgcgcaacgaacagctggagggcggcaagccaatctccatcggcaacgacgtatggttcggtggcaacgtcaccgtgtgcccgggcgtcacgatcggcgacgacgtggtgatcggcgccggctccgttgtggtcaaggacatcccctcacattgcattgccgtgggcaacccgtgccgcccgatccgtgccatcaccgatgccgaccacgaacagtggcagcgcaaggcacgtgaatatcgtgcatggaaagagggaatctaaggccggcacgaaccccggcgcgtcacccttgttacaatgacagcgtgaggcaaagaacagtgtcgatcattgcgggcgaccggcaggcgtcgtgcgggcgcaccacgcatccctgccacgatcggcgtatgccggaagggggacgtgatgtcgattagtgccagtgagaagccgctgtcgaaggtgttcacctccgactaccggttcaccataccctcgttccagcgatcatacagttggcatgatgcgcagatgcggcagctcgtcaacgacgtcatggacgcctgcgcgttgcacgacggaccgtacttccttgggtcgctgattctcgtgcatgacgaacgcggcatgcaccaggtgatcgacgggcagcaacgtctggtctcactgtcgatcctgttttcgatcctgcttgcgttggaggaggacccgcagctgacctccagtctggaaggactgcttatggaggccggcgacaagctgcgtggcatcaacgcggagccgagactcaccttgcgtgagcaggatgaggggttcttccgcgaatacgtgcagcagggcgacctcgaggcgctgttcgacctgcgcgagaccgatatccacacgcaggcccagcgcaatattcagggcaacacgagatgcgcgtacgacatcctggcgcgtatgcaggacgacgaacgccgccagttcgcgcaatacctggtcaacgatgtcatgttcgtcatcgtgaccacagacgacatctccggcgcctaccgcatcttcgacgtgatgaacatgcgtggcatgccgttgaccccctccgacgtgttcaaggcgaaggtggtttcgtccatctcaccggcggcacgcgacgcctacgccaggtattgggacgaaatcatggagccgatgggcgacgacaccgaacgcatcgaacgcttcttcaaggatctcgacctcatcgccaccaagacaccgctgtgtgaatcactcatcgccgatttcatggaccatgtgctcgagcgctatatgcgcaagggcgagggcatcgaatacatcgacgaggtgctgcggccatacgcgatcgccaatgagatcattcaccgacccggagaaagcctgttgccggacgatgtggtcgatctgctcataggactcaatgactacccctccaaggactggcatccagtcgccatgtgggtgctcgtgcattcgctcaaaggactcgacgaccctgacaccgtcgtcttcgaacggcagacggcggatcatgggcgcgaacaccaggtgaaggtgcatgacgcccaacgtctgcgtgacgtgctcgcctcgctcgaccgcgtcaccggcaccgattgcctgaacggcaagagcgagctcgaacggcgcacacgcgcgtccacaatcgtgcgcgatctgaacaaaggggctcttctcaagttagtgtgtaagggccgtgcttcatcattgcttgtgtgatagagaaattgaatgaggaaacacggcctgaacccgagtttagcgtgttcgacccccaacgtttccttggtttggatgagatgggtcttcgtgtgctctcgtggcggcgtcttggcaggccggacggcccggggttaaggcagatcaggtgcgagccggactcgcacgacgcgcgctggtgcccctcgtgcggcgcgtatgccagggtgcgttcgtcgtggctgcgcacgctggcgcatgtgccctacggcgacgacgcggtgcatctgctggtgcgcgtgcgccgctacgagtgcgtgccgtgctcacgctcgtggagcgatgatcctgaggcggtgggcgccggcaggggcgtgttgagcgtgccggcggtgatgtgggcgctgcggcgcgtgtgcctggactcgatgacggtctcggcgtgcgccaggctgcttcatgtggcatgggcggtggtcgaccgggcggtgcgcgagcggggcatgctgttgctcgagcaggccgaccggttctcctcggtgcgcgcgatcggcgtggacgagcacgtgtggcgccacggcgcgttcggcgaccggtacgtgaccgtgatcgtcgacctgaccccgcgttgcgacggcaggccggcaagactgctggacatggtgccgggccgttccgcccaggtgcttcgcgaatggatgcaggcgcgcggcggcgagttcacaagacgcgtcggggtggtcgccatggacgcgttcgccggctggaagcaggccgtcgaatccgtcgtgccccacgcggtcgaggtcatcgacccgttccacgtcgtgcaactggccgccgcccgcgtcaccagggtgcgctgccgcctgcaacgcgacgccaccggcaggcgcggtgtcaagggcgacaggctctacgactgcaggcgcgccctgctgaccagcgacgaatacctcggcgcacgcggccgtgccagactcatggccctgttcgccatccaggccaaccgcgacctcatgctcgcccacgacgcctaccaaagggtcatacacgcctaccggtgcgacgacaggcgacgcggcgaacgcatgatgcgcgagctgatcgacgacctgaccggaccggggcgctacaaaggctgccgggaactcgcctccctcggccgcgtgctcaaaagacgcatgcgcgacatcctcgccctcttccgccacccccgctcaagcaacggacccaccgaagccatcaacggcaggctcgagaccctgcgcggcaacgccatgggcttcgccaacaccaccagctacatccaacgatgcctcatccacagcagccaactcaaagacatccttacacactaacctgagaagagccccttttacgcatctttatgcctctcgccagcgaacggtcccggcgctatctgcgtaaaaagagacaaaaaccacgcctcaaacgtccccttttacgccgggaggaagcttgtaacgcaagagaaggaacgtgtccatatacgcaaagaggagggccaccccaatggggtggccctcctctcgctagttattcagctcgggcccctcgtggaagaagtggacgagggaccacgtttccattcgccgctcactggttggcgtgggcgttgtcgtactcggtcttccagttgtcgacgaaggccttctgcacgtcatcccagctgccgttgccctgcgcgtaggcgagcatggcctggccgagctggttcttccactcctccgacggcatcatcgtgaagttccaagcaacctgctccttgccggagttggagtcctcgacggcctcctcgacgagcgggttgtcgctcttcaccttgtcgaaggtcttgaacggcgtggtgaagcccatgtcttccgacagcgccttgatgccctcgtcggaggtgacgacccagttcaggaagtccttcgaggccttctggtcggcctcggaggccttcgcattgatgcacaggtagttctcggagccggtggccagtccctggttctcctcgcccttggcaccgatgtagattgggagcatgcccacctgatcgggcttcatgccggccttctgcagatcggtccaggcccaagtgccgttctggtagaacgcggcctcgccgagcgcgaactcggagttcgcgtcatcgccggtcttcgagctcagctgagacggggcggtggtggaatccttgaggtacaggtcgaagatgttcttgaagttcggcaggtaggtgcccttgatcgtctccggctgcgtggtcacaccgtcctccttgaactcataggagagcgggatgttcgccaagtgggtcttgaaacgccagtcggagctggagtcgaagcccgcggaggtgaaggctcccttgatgccgagctgatccttcttggcctgcatgtcgtcggccacttccttgagcttgtcgaaggagtcgatctccttgacgtccttgatcttggcgcccggcagctcggtatacttcttgagcaggtccttgttgtagatgatgccgtaggtctccatgacgtacgggatgcccacgaccttgtcgccgtccttcagcgcgatgtccttgttattgagctcgttgtagatgccggtgtccttgaggtcggcagtgtagcccttccagttctggtagccgaccggtccgttgacctggaagatcgtcggcgcgtcgctcttggcgagctcggacttgagcgtctgctcgtaggtgcccgaggcggccgtctgcaccttcacctgcacgccggtcttgtcggtgtatttcttggcgagcgcgacccactggtcggcggcctccggcttgaagttcaggaagtagaccttgcccttgccgtcgtccgcgctgcttcctccgcacgcggccaggccggtgagagacattgcggcgatcgccacgagacccactgttgctttcactgtgcgattcatcttcgaacctttcctcatcccacttcagccactcaccgaagtggcaccgaagtattttcctgaagccgcgccctcgcggacttcgtagccccttcattatgcatcattcctgagcagattgcaaacgtgggcagtaagtttgcgtacaaattgtggagattgccgtgcagattgactcaaaaatactttattttcaacgcttttcactgcgacacgcactatgcaagcgtttgctcacgatctgcaaacatgggcgtttcgcacagcattacgtctccagacgacacggcggggcgaccgggcaaacggtattacaatggttcctgaatttgtttccaaaaacaagaaaagagcttccatgaccgcgaacaacatgcacgacgactggtggaaacaggccgttgtctatcaggtgtacccgcgtagcttccgcgacgccaacggcgacggactcggagacatcgccggcatcaccgaacaggtgccgtatctcaagcaccttggcgtggatgccatctggctctccccgttctacccttccgagcttgcagatggcggctatgatgtgatcgactaccgcaacgtggacccacgtctgggcacgcttgaggatttcgacgaactcgtgacggcgctccacgcgcatggcatgaagatcgtcgtcgacatcgtgccgaaccacacctcgaacatgcacgaatggttccaggcggcactgaccgcggaacccggctcgccggaacgcgaccgctacatcttccgcgaagggcgcggcgaacacggcgaactgccaccgaacgactggcagtcgctgttcggggggccggcctggcaacgcgtggccgacggccaatggtatctgcacatcttcacagtggagcagccggacctcaactggaagaaccccgaggtgcatgaggacttcaagaagacactgcgcttctggtccgaccgtggagtggacggattccgcatcgacgtggcgcatggcctcgccaaggatctcgacagcaaacccctcgccgagatggacgcggactgcgtgttcgacaccgacaatcgcaatgggaacaacccgctgtgggaccgcgccgaagtgcacgacatctaccgtgaatggaacgccgtgttcaatgaataccggccagcacgcttcgccgtcggcgaggcatgggtgattcccgagcaccagcacctctacgcgcgcgaaggcgagctcggacaggtgttcaacttcgaattcgccaaggcgaactggaatgcggcggcgttcaaggtcgccatcgaagacggcatccggtcggcacacgacgcggaatcgaccaccacctgggtgatgagcaaccacgatgtggtgcgtcacgccagccggtacggtctgccgcaggtgcccaccaccggctatcacgagctgccgaacgactggctgctgcgcgacggcaccacatacatcgaagaccgcgacctcggcgcgcgccgtgcccgtgcggcgatcctgatggaactcggcctgccgggctcggtgtacgtgtatcagggcgaggagctcggccttcctgaagtggcgaacattccgtggaatcatctcgaagacccgatcgcgttccacaccgaccatgccggcgcacagaaaggccgcgatggctgccgcgtgccactgccatggcgtgccgacgacgaaccccggcctgcagattgggatccgctgttcggcaccggagcctcgttcgggttctcggacgccccggccgacggttcggcgccggccgatccgcatctgccgcagccgttgtggtacaagcagtatgccgccgacaagcagatggctgacgacacctcgatgttcaacctgtaccggcaggcgatgcaattccgccaggaacacctgacgccgagcgacgacaccgacgacatcacgtggctacccggcaccgatttcaacgcccacaacgccgaagtggtcgcctatacgcgcccctgcacgggtgagggcgatggcaccttcgcgtgcatcgtcaactttggccccgatccgatcgacctgcccgcaggcacggtggttttgagctccgagccgctcgacgaaccgcacaagctgtctgccgacactgccgtctggatgctgctcccctgagtcggcagtaatcgcaagggcagtcgcgaagtgatggcccggagggcgggccggatagggcctcgtcactggatcgcaagcgcccttgacgttcctcaaccctatccggcccgccctccgggccatcacttcgctcggcattacatcccatcacccaaatgtaaggaaagtcgcgctcccaaaccataaacgagcattaaaaggtgaggcgtcggctggggccgggccgaaaggctgaggaacgtcaagggcgcgtggcgatccagtgacgaagcctttcggcccggccccagccgacgccgtcgctgttatcaatctgcagccaaaaccggctcttctcaagttagtgtgtaagggccgtgcttcatcattgcttgtgtgatagagaaattgaatgaggagacacggcctgaacccgagtttagcgtgttcgacccccaacgtttccttggtttggatgagatgggtcttcgtgtgctctcgtggcggcgtcttggcaggccggacggcccggggttaaggcagatcaggtgcgagccggactcgcacgacgcgcgctggtgcccctcgtgcggcgcgtatgccagggtgcgttcgtcgtggctgcgcacgctggcgcatgtgccctacggcgacgacgcggtgcatctgctggtgcgcgtgcgccgctacgagtgcgtgccgtgctcacgctcgtggagcgatgatcctgaggcggtgggcgccggcaggggcgtgttgagcgtgccggcggtgatgtgggcgctgcggcgcgtgtgcctggactcgatgacggtctcggcgtgcgccaggctgcttcatgtggcatgggcggtggtcgaccgggcggtgcgcgagcggggcatgctgttgctcgagcaggccgaccggttctcctcggtgcgcgcgatcggcgtggacgagcacgtgtggcgccacggcgcgttcggcgaccggtacgtgaccgtgatcgtcgacctgaccccgcgttgcgacggcaggccggcaagactgctggacatggtgccgggccgttccgcccaggtgcttcgcgaatggatgcaggcgcgcggcggcgagttcacaagacgcgtcggggtggtcgccatggacgcgttcgccggctggaagcaggccgtcgaatccgtcgtgccccacgcggtcgaggtcatcgacccgttccacgtcgtgcaactggccgccgcccgcgtcaccagggtgcgctgccgcctgcaacgcgacgccaccggcaggcgcggtgtcaagggcgacaggctctacgactgcaggcgcgccctgctgaccagcgacgaatacctcggcgcacgcggccgtgccagactcatggccctgttcgccatccaggccaaccgcgacctcatgctcgcccacgacgcctaccaaagggtcatacacgcctaccggtgcgacgacaggcgacgcggcgaacgcatgatgcgcgagctgatcgacgacctgaccggaccggggcgctacaaaggctgccgggaactcgcctccctcggccgcgtgctcaaaagacgcatgcgcgacatcctcgccctcttccgccacccccgctcaagcaacggacccaccgaagccatcaacggcaggctcgagaccctgcgcggcaacgccatgggcttcgccaacaccaccagctacatc

SEQ ID NO: 2 - DNA, 33 bp, Artificial Sequence
  Description of Artificial Sequence: Synthetic oligonucleotide
ggcgctcggcaccctggcgattggcgcggcaac

What is claimed is:

1. A method of treating cancer in a subject comprising administering to the subject an effective amount of a bacterial composition comprising *Bifidobacterium animalis* ssp. *lactis* Strain A (ATCC Deposit Number PTA-125097) to treat the cancer.

2. The method of claim 1, wherein the cancer is a non-small cell lung cancer.

3. The method of claim 1, wherein the cancer is a colorectal cancer.

4. The method of claim 1, wherein the cancer is a triple negative breast cancer.

5. The method of claim 1, wherein the cancer is a bladder cancer.

6. The method of claim 1, wherein the cancer is a gastroesophageal cancer.

7. The method of claim 1, wherein the cancer is a renal cell carcinoma.

8. The method of claim 1, wherein the cancer is a solid tumor.

9. The method of claim 1, wherein the bacterial composition is administered orally.

10. The method of claim 1, wherein the bacterial composition is formulated as a capsule or a tablet.

11. The method of claim 1, wherein the bacterial composition comprises at least $7.5 \times 10^{10}$ colony forming units (CFUs) of *Bifidobacterium animalis* ssp. *lactis*.

12. The method of claim 1, wherein the bacterial composition is administered at least once daily.

13. The method of claim 1, wherein the bacterial composition is administered twice daily.

14. The method of claim 1, wherein the bacterial composition is administered in two or more doses.

15. The method of claim 1, wherein the method further comprises administering to the subject a second cancer therapy.

16. The method of claim 15, wherein the second cancer therapy is administered once every 1 week, 2 weeks, 3 weeks, 4 weeks, or 5 weeks.

17. The method of claim 15, wherein the second cancer therapy comprises cancer immunotherapy.

18. The method of claim 17, wherein the cancer immunotherapy comprises administering an immune checkpoint inhibitor to the subject.

19. The method of claim 18, wherein the immune checkpoint inhibitor is an anti-PD-1 antibody.

20. The method of claim 19, wherein the anti-PD-1 antibody is nivolumab.

21. The method of claim 19, wherein the anti-PD-1 antibody is pembrolizumab.

22. The method of claim 21, wherein pembrolizumab is administered intravenously.

23. The method of claim 18, wherein the immune checkpoint inhibitor is an anti-PD-L1 antibody.

24. The method of claim 23, wherein the anti-PD-L1 antibody is atezolizumab, avelumab, or durvalumab.

25. The method of claim 23, wherein the anti-PD-L1 antibody is administered intravenously.

26. The method of claim 18, wherein the immune checkpoint inhibitor is an anti-CTLA-4 antibody.

27. The method of claim 26, wherein the anti-CTLA-4 antibody is ipilimumab.

28. The method of claim 27, wherein ipilimumab is administered intravenously.

* * * * *